United States Patent 7,745,391 (HUMAN THROMBOSPONDIN POLYPEPTIDE) - sequence listing, part 279

SEQ ID NO: 853369 - protein, 1714 aa, Homo sapiens
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETGFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYIFLRLSRECCEELNLRPDCDTQVELQFQLNRLPLCEMHYALDRIKDNGVLFPDISMTPTIPWSPNRQWDEQLDPRLNAKQKEAVLAITTPLAIQLPPVLIIGPYGTGKTFTLAQAVKHILQQQETRILICTHSNSAADLYIKDYLHPYVEAGNPQARPLRVYFRNRWVKTVHPVVHQYCLISSAHSTFQMPQKEDILKHRVVVVTLNTSQYLCQLDLEPGFFTHILLDEAAQAMECETIMPLALATQNTRIVLAGDHMQLSPFVYSEFARERNLHVSLLDRLYEHYPAEFPCRILLCENYRSHEAIINYTSELFYEGKLMASGKQPAHKDFYPLTFFTARGEDVQEKNSTAFYNNAEVFEVVERVEELRRKWPVAWGKLDDGSIGVVTPYADQVFRIRAELRKKRLSDVNVERVLNVQGKQFRVLFLSTVRTRHTCKHKQTPIKKKEQLLEDSTEDLDYGFLSNYKLLNTAITRAQSLVAVVGDPIALCSIGRCRKFWERFIALCHENSSLHGITFEQIKAQLEALELKKTYVLNPLAPEFIPRALRLQHSGSTNKQQQSPPKGKSLHHTQNDHFQNDGIVQPNPSVLIGNPIRAYTPPPPLGPHPNLGKSPSPVQRIDPHTGTSILYVPAVYGGNVVMSVPLPVPWTGYQGRFAVDPRIITHQAAMAYNMNLLQTHGRGSPIPYGLGHHPPVTIGQPQNQHQEKDQHEQNRNGKSDTNNSGPEINKIRTPEKKPTEPKQVDLESNPQNRSPESRPSVVYPSTKFPRKDNLNPRHINLPLPAPHAQYAIPNRHFHPLPQLPRPPFPIPQQHTLLNQQQNNLPEQPNQIPPQPNQVVQQQSQLNQQPQQPPPQLSPAYQAGPNNAFFNSAVAHRPQSPPAEAVIPEQQPPPMLQEGHSPLRAIAQPGPILPSHLNSFIDENPSGLPIGEALDRIHGSVALETLRQQQARFQQWSEHHAFLSQGSVPYPHHHHPHLQHLPQPPLGLHQPPVRADWKLTSSAEDEVETTYSRFQDLIRELSHRDQSETRELAEMPPPQSRLLQYRQVQSRSPPAVPSPPSSTDHSSHFSNFNDNSRDIEVASNPAFPQRLPPQIFNSPFSLPSEHLAPPPLKYLAPDGAWTFANLQQNHLMGPGFPYGLPPLPHRPPQNPFVQIQNHQHAIGQEPFHPLSSRTVSSSSLPSLEEVNVFLFSFCY

SEQ ID NO: 853370 - protein, 466 aa, Homo sapiens
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETGFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKDGILPCCPGKIWNSWAQVIHPLWPPKVLGLQA

SEQ ID NO: 853371 - protein, 1942 aa, Homo sapiens
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETETATSNALSGYHVEDLDEGSCNGWHFRPPPRGITSSEEYTLCKRFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYIFLRLSRECCEELNLRPDCDTQVELQFQLNRLPLCEMHYALDRIKDNGVLFPDISMTPTIPWSPNRQWDEQLDPRLNAKQKEAVLAITTPLAIQLPPVLIIGPYGTGKTFTLAQAVKHILQQQETRILICTHSNSAADLYIKDYLHPYVEAGNPQARPLRVYFRNRWVKTVHPVVHQYCLISSAHSTFQMPQKEDILKHRVVVVTLNTSQYLCQLDLEPGFFTHILLDEAAQAMECETIMPLALATQNTRIVLAGDHMQLSPFVYSEFARERNLHVSLLDRLYEHYPAEFPCRILLCENYRSHEAIINYTSELFYEGKLMASGKQPAHKDFYPLTFFTARGEDVQEKNSTAFYNNAEVFEVVERVEELRRKWPVAWGKLDDGSIGVVTPYADQVFRIRAELRKKRLSDVNVERVLNVQGKQFRVLFLSTVRTRHTCKHKQTPIKKKEQLLEDSTEDLDYGFLSNYKLLNTAITRAQSLVAVVGDPIALCSIGRCRKFWERFIALCHENSSLHGITFEQIKAQLEALELKKTYVLNPLAPEFIPRALRLQHSGSTNKQQQSPPKGKSLHHTQNDHFQNDGIVQPNPSVLIGNPIRAYTPPPPLGPHPNLGKSPSPVQRIDPHTGTSILYVPAVYGGNVVMSVPLPVPWTGYQGRFAVDPRIITHQAAMAYNMNLLQTHGRGSPIPYGLGHHPPVTIGQPQNQHQEKDQHEQNRNGKSDTNNSGPEINKIRTPEKKPTEPKQVDLESNPQNRSPESRPSVVYPSTKFPRKDNLNPRHINLPLPAPHAQYAIPNRHFHPLPQLPRPPFPIPQQHTLLNQQQNNLPEQPNQIPPQPNQVVQQQSQLNQQPQQPPPQLSPAYQAGPNNAFFNSAVAHRPQSPPAEAVIPEQQPPPMLQEGHSPLRAIAQPGPILPSHLNSFIDENPSGLPIGEALDRIHGSVALETLRQQQARFQQWSEHHAFLSQGSVPYPHHHHPHLQHLPQPPLGLHQPPVRADWKLTSSAEDEVETTYSRFQDLIRELSHRDQSETRELAEMPPPQSRLLQYRQVQSRSPPAVPSPPSSTDHSSHFSNFNDNSRDIEVASNPAFPQRLPPQIFNSPFSLPSEHLAPPPLKYLAPDGAWTFANLQQNHLMGPGFPYGLPPLPHRPPQNPFVQIQNHQHAIGQEPFHPLSSRTVSSSSLPSLEEYEPRGPGRPLYQRRISSSSVQPCSEEVSTPQDSLAQCKELQDHSNQSSFNFSSPESWVNTTSSTPYQNIPCNGSSRTAQPRELIAPPKTVKPPEDQLKSENLEVSSSFNYSVLQHLGQFPPLMPNKQIAESANSSSPQSSAGGKPAMSYASALRAPPKPRPPPEQAKKSSDPLSLFQELSLGSSSGSNGFYSYFK

SEQ ID NO: 853372 - protein, 1942 aa, Homo sapiens; identical to SEQ ID NO: 853371

SEQ ID NO: 853373 - protein, 1899 aa, Homo sapiens
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETGFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYIFLRLSRECCEELNLRPDCDTQVELQFQLNRLPLCEMHYALDRIKDNGVLFPDISMTPTIPWSPNRQWDEQLDPRLNAKQKEAVLAITTPLAIQLPPVLIIGPYGTGKTFTLAQAVKHILQQQETRILICTHSNSAADLYIKDYLHPYVEAGNPQARPLRVYFRNRWVKTVHPVVHQYCLISSAHSTFQMPQKEDILKHRVVVVTLNTSQYLCQLDLEPGFFTHILLDEAAQAMECETIMPLALATQNTRIVLAGDHMQLSPFVYSEFARERNLHVSLLDRLYEHYPAEFPCRILLCENYRSHEAIINYTSELFYEGKLMASGKQPAHKDFYPLTFFTARGEDVQEKNSTAFYNNAEVFEVVERVEELRRKWPVAWGKLDDGSIGVVTPYADQVFRIRAELRKKRLSDVNVERVLNVQGKQFRVLFLSTVRTRHTCKHKQTPIKKKEQLLEDSTEDLDYGFLSNYKLLNTAITRAQSLVAVVGDPIALCSIGRCRKFWERFIALCHENSSLHGITFEQIKAQLEALELKKTYVLNPLAPEFIPRALRLQHSGSTNKQQQSPPKGKSLHHTQNDHFQNDGIVQPNPSVLIGNPIRAYTPPPPLGPHPNLGKSPSPVQRIDPHTGTSILYVPAVYGGNVVMSVPLPVPWTGYQGRFAVDPRIITHQAAMAYNMNLLQTHGRGSPIPYGLGHHPPVTIGQPQNQHQEKDQHEQNRNGKSDTNNSGPEINKIRTPEKKPTEPKQVDLESNPQNRSPESRPSVVYPSTKFPRKDNLNPRHINLPLPAPHAQYAIPNRHFHPLPQLPRPPFPIPQQHTLLNQQQNNLPEQPNQIPPQPNQVVQQQSQLNQQPQQPPPQLSPAYQAGPNNAFFNSAVAHRPQSPPAEAVIPEQQPPPMLQEGHSPLRAIAQPGPILPSHLNSFIDENPSGLPIGEALDRIHGSVALETLRQQQARFQQWSEHHAFLSQGSVPYPHHHHPHLQHLPQPPLGLHQPPVRADWKLTSSAEDEVETTYSRFQDLIRELSHRDQSETRELAEMPPPQSRLLQYRQVQSRSPPAVPSPPSSTDHSSHFSNFNDNSRDIEVASNPAFPQRLPPQIFNSPFSLPSEHLAPPPLKYLAPDGAWTFANLQQNHLMGPGFPYGLPPLPHRPPQNPFVQIQNHQHAIGQEPFHPLSSRTVSSSSLPSLEEYEPRGPGRPLYQRRISSSSVQPCSEEVSTPQDSLAQCKELQDHSNQSSFNFSSPESWVNTTSSTPYQNIPCNGSSRTAQPRELIAPPKTVKPPEDQLKSENLEVSSSFNYSVLQHLGQFPPLMPNKQIAESANSSSPQSSAGGKPAMSYASALRAPPKPRPPPEQAKKSSDPLSLFQELSLGSSSGSNGFYSYFK

SEQ ID NO: 853374 - protein, 68 aa, Homo sapiens
AAAYYYYCSEFKLLTMYGDMSYASALRAPPKPRPPPEQAKKSSDPLSLFQELSLGSSSGSNGFYSYFK

SEQ ID NO: 853375 - protein, 347 aa, Homo sapiens
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETGFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEGNI

SEQ ID NO: 853376 - protein, 255 aa, Homo sapiens
LYPSEGSSIEERQRKNLQAKPVHQALGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETEQIIILMELFK

SEQ ID NO: 853377 - protein, 171 aa, Homo sapiens
LYPSEGSSIEERQRKNLQAKPVHQALGSSSTLPKDPVLRKEKLQDLMTQIQGTCNFMQESVLDFDKPSSAIPTSQPPSATPGSPVASKEQNLSSQSDFLQEPLQVFNVNAPLPPRKEQEIKESPYSPGYNQSFTTASTQTPPQCQLPSIHVEQTVHSQETEQIIILMELFK

SEQ ID NO: 853378 - protein, 264 aa, Homo sapiens
ILIYIYFNTKNENATEKDLRGFDTYRGLPSISNGNYSQLQFQAREYSGAPYSQRDNFQQCYKRGGTSGGPRANSRAGWSDSSQVSSPERDNETFNSGDSGQGDSRSMTPVDVPVTNPAATILPVHVYPLPQQMRVAFSAARTSNLAPGTLDQPIVFDLLLNNLGETFDLQLGRFNCPVNGTYVFIFHMLKLAVNVPLYVNLMKNEEVLVSAYANDGAPDHETASNHAILQLFQGDQIWLRLHRGAIYGSSWKYSTFSGYLLYQD

SEQ ID NO: 853379 - protein, 255 aa, Homo sapiens
LYPSEGSSIEERQRKNLQAKPVHQALGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETGKIFAYDIWKT

SEQ ID NO: 853380 - protein, 220 aa, Homo sapiens
LYPSEGSSIEERQRKNLQAKPVHQALGSSSTLPKDPVLRKEKLQDLMTQIQGTCNFMQESVLDFDKPSSAIPTSQPPSATPGSPVASKEQNLSSQSDFLQEPLQAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETEQIIILMELFK

SEQ ID NO: 853381 - protein, 480 aa, Homo sapiens
LYPSEGSSIEERQRKNLQAKPVHQALGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEVFNVNAPLPPRKEQEIKESPYSPGYNQSFTTASTQTPPQCQLPSIHVEQTVHSQETAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRAGWSDSSQVSSPERDNETFNSGDSGQGDSRSMTPVDVPVTNPAATILPVHVYPLPQQMRVAFSAARTSNLAPGTLDQPIVFDLLLNNLGETFDLQLGRFNCPVNGTYVFIFHMLKLAVNVPLYVNLMKNEEVLVSAYANDGAPDHETASNHAILQLFQGDQIWLRLHRGAIYGSSWKYSTFSGYLLYQD

SEQ ID NO: 853382 - protein, 158 aa, Homo sapiens
MTPVDVPVTNPAATILPVHVYPLPQQMRVAFSAARTSNLAPGTLDQPIVFDLLLNNLGETFDLQLGRFNCPVNGTYVFIFHMLKLAVNVPLYVNLMKNEEVLVSAYANDGAPDHETASNHAILQLFQGDQIWLRLHRGAIYGSSWKYSTFSGYLLYQD

SEQ ID NO: 853383 - protein, 89 aa, Homo sapiens
STPSPSSSPQPVPTAHIRADRPRPHPPVLSLLSAGKFVRESNIAALRLRHGGGARIGSCREIRKLSAPGPGSEQKRLPPAPLRDPTLRD

SEQ ID NO: 853384 - protein, 89 aa, Homo sapiens; identical to SEQ ID NO: 853383

SEQ ID NO: 853385 - protein, 107 aa, Homo sapiens [sequence omitted]

SEQ ID NO: 853386 - protein, 954 aa, Homo sapiens
MPSTSCRMKHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWKCLKFLGSRHPTLVLPLVPELLSTHPFFDTAEPDMDDPAYIAVLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRVEVSPWWPGWSQTPELKDPPASASQSAGITGVSHCARPRLILSSVFIFCIKQPLLNNSDLTVPPVFHPVGKRKQEEKGISFLMSKSPGGIVNYRNVTCRAGDGRKCHSPVDGFFQATVKPDVFMPALKQTASQVTQTLRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCEKFLQEVDFFQRYFIADLPHLQDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 853387 - protein, 109 aa, Homo sapiens
MESLCVAQAGREFLSSSNPPAWPSQRIGITDENDPSVRLKIASLLGLLSKTAGFSPDCIMDDAINILQNEKSHQVLAQLLDTLLAIGTKLPENQAIQMRLVDVACKVRV

SEQ ID NO: 853388 - protein, 963 aa, Homo sapiens
MAAHLKKRVYEEFTKVVQPQEEIATKKLRLTKPSKSAALHIDLCKATSPADALQYLLQFARKPVEAESVEGVVRILLEHYYKENDPSVRLKIASLLGLLSKTAGFSPDCIMDDAINILQNEKSHQVLAQLLDTLLAIGTKLPENQAIQMRLVDVACKHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWKCLKFLGSRHPTLVLPLVPELLSTHPFFDTAEPDMDDPAYIAVLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCEKFLQEVDFFQRYFIADLPHLQDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 853389 - protein, 963 aa, Homo sapiens; identical to SEQ ID NO: 853388

SEQ ID NO: 853390 - protein, 978 aa, Homo sapiens
MAAHLKKRVYEEFTKVVQPQEEIATKKLRLTKPSKSAALHIDLCKATSPADALQYLLQFARKPVEAESVEGVVRILLEHYYKENDPSVRLKIASLLGLLSKTAGFSPDCIMDDAINILQNEKSHQVLAQLLDTLLAIGTKLPENQAIQMRLVDVACKHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWKYMTFLPIYSLSPIMWCLKFLGSRHPTLVLPLVPELLSTHPFFDTAEPDMDDPAYIAVLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCEKFLQEVDFFQRYFIADLPHLQDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 853391 - protein, 912 aa, Homo sapiens
MESLCVAQAGREFLSSSNPPAWPSQRIGITDENDPSVRLKIASLLGLLSKTAGFSPDCIMDDAINILQNEKSHQVLAQLLDTLLAIGTKLPENQAIQMRLVDVACKHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWKCLKFLGSRHPTLVLPLVPELLSTHPFFDTAEPDMDDPAYIAVLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCEKFLQEVDFFQRYFIADLPHLQDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 853392 - protein, 590 aa, Homo sapiens
MIGACEYVMGEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWKCLKFLGSRHPTLVLPLVPELLSTHPFFDTAEPDMDDPAYIAVLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCEKFLQEVDFFQRYFIADLPHLQDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 853393 - protein, 963 aa, Homo sapiens; identical to SEQ ID NO: 853388

SEQ ID NO: 853394 - protein, 425 aa, Homo sapiens
MDDPAYIAVLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCEKFLQEVDFFQRYFIADLPHLQDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 853395 - protein, 162 aa, Homo sapiens
MLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 853396 - protein, 505 aa, Homo sapiens
MAAHLKKRVYEEFTKVVQPQEEIATKKLRLTKPSKSAALHIDLCKATSPADALQYLLQFARKPVEAESVEGVVRILLEHYYKENDPSVRLKIASLLGLLSKTAGFSPDCIMDDAINILQNEKSHQVLAQLLDTLLAIGTKLPENQAIQMRLVDVACKHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWK

SEQ ID NO: 853397 - protein, 964 aa, Homo sapiens
MAAHLKKRVYEEFTKVVQPQEEIATKKLRLTKPSKSAALHIDLCKATSPADALQYLLQFARKPVEAESVEGVVRILLEHYYKENDPSVRLKIASLLGLLSKTAGFSPDCIMDDAINILQNEKSHQVLAQLLDTLLAIGTKLPENQAIQMRLVDVACKHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWKCLKFLGSRHPTLVLPLVPELLSTHPFFDTAEPDMDDPAYIAVLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGTWFHCVVQASLELLNSKCPSTSASQSARITDDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 853398 - protein, 963 aa, Homo sapiens; identical to SEQ ID NO: 853388

SEQ ID NO: 853399 - protein, 743 aa, Homo sapiens [sequence omitted]

SEQ ID NO: 853400 - protein, 441 aa, Homo sapiens
MAAHLKKRVYEEFTKVVQPQEEIATKKLRLTKPSKSAALHIDLCKATSPADALQYLLQFARKPVEAESVEGVVRILLEHYYKENDPSVRLKIASLLGLLSKTAGFSPDCIMDDAINILQNEKSHQVLAQLLDTLLAIGTKLPENQAIQMRLVDVACKHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYDVTTGGNQHRGHHSLQQACKSLYNAQTCTALRQKQSSQPWPRGPFLGVRMSQA

SEQ ID NO: 853401 - protein, 432 aa, Homo sapiens [sequence omitted]

SEQ ID NO: 853402 - protein, 824 aa, Homo sapiens
MAAAFEASGALAAVATAMPAEHVAVQVPAPEPTPGPVRILRTAQDLSSPRTRTGDVLLAEPADFESLLLSRPVLEGLRAAGFERPSPVQLKAIPLGRCGLDLIVQAKSGTGKTCVFSTIALDSLVLENLSTQILILAPTREIAVQIHSVITAIGIKMEGLECHVFIGGTPLSQDKTRLKKCHIAVGSPGRIKQLIELDYLNPGSIRLFILDEADKLLEEGSFQEQINWIYSSLPASKQMLAVSATYPEFLANALTKYMRDPTFVRLNSSDPSLIGLKQYYKVVNSYPLAHKVFEEKTQHLQELFSRIPFNQALVFSNLHSRAQHLADILSSKGFPAECISGNMNQNQRLDAMAKLKHFHCRVLISTDLTSRGIDAEKVNLVVNLDVPLDWETYMHRIGRAGRFGTLGLTVTYCCRGEEENMMMRIAQKCNINLLPLPDPIPSGLMEECVDWDVEVKAAVHTYGIASVPNQPLKKQIQKIERTLQIQKAHGDHMASSRNNSVSGLSVKSKNNTKQKLPVKSHSECGIIEKATSPKELGCDRQSEEQMKNSVQTPVENSTNSQHQVKEALPVSLPQIPCLSSFKIHQPYTLTFAELVEDYEHYIKEGLEKPVEIIRHYTGPGDQTVNPQNGFVRNKVIEQRVPVLASSSQSGDSESDSDSYSSRTSSQSKGNKSYLEGSSDNQLKDSESTPVDDRISLEQPPNGSDTPNPEKYQESPGIQMKTRLKEGASQRAKQSRRNLPRRSSFRLQTEAQEDDWYDCHREIRLSFSDTYQDYEEYWRAYYRAWQEYYAAASHSYYWNAQRHPSWMAAYHMNTIYLQEMMHSNQ

SEQ ID NO: 853403 - protein, 824 aa, Homo sapiens; identical to SEQ ID NO: 853402

SEQ ID NO: 853404 - protein, 1079 aa, Homo sapiens
MVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKLIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 853405 - protein, 655 aa, Homo sapiens
SGGGGSGERDAGCRRDAWLEDASDGGRTLRWSGLVSPAWAWSAGWQSLWTFGARPVRAPGAPEVASGERRAASGPRRPRSCRHAADEPSRRREDAAVARARAGGPRGPIRRRAEPEARRGEARRRCTHAHGAMGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQEKEAPPNP

SEQ ID NO: 853406 - protein, 2877 aa, Homo sapiens
VPDVSPEEASLRATFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFDAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMTFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 853407 - protein, 1344 aa, Homo sapiens
SGGGGSGERDAGCRRDAWLEDASDGGRTLRWSGLVSPAWAWSAGWQSLWTFGARPVRAPGAPEVASGERRAASGPRRPRSCRHAADEPSRRREDAAVARARAGGPRGPIRRRAEPEARRGEARRRCTHAHGAMGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQEEDLASPCISPAPPRRAFQSSGEKETSQFPGKELRREPGPSKAQNRAAFTEPLAEAPLLGSKQAQEERAPLPREQAQQLQGSEGEKGGP

SEQ ID NO: 853408 - protein, 662 aa, Homo sapiens
SGGGGSGERDAGCRRDAWLEDASDGGRTLRWSGLVSPAWAWSAGWQSLWTFGARPVRAPGAPEVASGERRAASGPRRPRSCRHAADEPSRRREDAAVARARAGGPRGPIRRRAEPEARRGEARRRCTHAHGAMGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 853409 - protein, 98 aa, Homo sapiens
QSGLFDINSSTGEASVPPSTPSLILGWGWPHCWIEGLPSQCWTQAVRGDPIFHSPESPSCSWVISPSGLAGGRGKRLGDDTQDLCWCTNSQPGPGAPQ

SEQ ID NO: 853410 - protein, 3486 aa, Homo sapiens
SGGGGSGERDAGCRRDAWLEDASDGGRTLRWSGLVSPAWAWSAGWQSLWTFGARPVRAPGAPEVASGERRAASGPRRPRSCRHAADEPSRRREDAAVARARAGGPRGPIRRRAEPEARRGEARRRCTHAHGAMGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFDAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMTFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 853411 - protein, 1193 aa, Homo sapiens
SGGGGSGERDAGCRRDAWLEDASDGGRTLRWSGLVSPAWAWSAGWQSLWTFGARPVRAPGAPEVASGERRAASGPRRPRSCRHAADEPSRRREDAAVARARAGGPRGPIRRRAEPEARRGEARRRCTHAHGAMGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGAAPASAHLCRPPGALPPPLPDGQPD

SEQ ID NO: 853412 - protein, 3471 aa, Homo sapiens
SGGGGSGERDAGCRRDAWLEDASDGGRTLRWSGLVSPAWAWSAGWQSLWTFGARPVRAPGAPEVASGERRAASGPRRPRSCRHAADEPSRRREDAAVARARAGGPRGPIRRRAEPEARRGEARRRCTHAHGAMGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFDAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMTFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRYPATVPHSPSRPPHCPGFTLVLLPQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 853413 - protein, 57 aa, Homo sapiens
MDGILRTFDLFMAYSPGYFVVDIVARDLAGHNDTAIIGIYILRDDQRVKIVINEIPD

SEQ ID NO: 853414 - protein, 68 aa, Homo sapiens
EAAILENLALGTEIVRVQAYSIDNLNQITYRFDAYTSTQAKALFKIDAITVEGLGAGSTISSNLTNIG

SEQ ID NO: 853415 - protein, 301 aa, Homo sapiens
MKSNPAIQAAIDLTAGAAGGTACVLTGQPFDTMKVKMQTFPDLYRGLTDCCLKTYSQVGFRGFYKGTSPALIANIAENSVLFMCYGFCQQVVRKVAGLDKQAKLSDLQNAAAGSFASAFAALVLCPTELVKCRLQTMYEMETSGKIAKSQNTVWSVIKSILRKDGPLGFYHGLSSTLLREVPGYFFFFGGYELSRSFFASGRSKDELGPVPLMLSGGVGGICLWLAVYPVDCIKSRIQVLSMSGKQAGFIRTFINVVKNEGITALYSGLKPTMIRAFPANGALFLAYEYSRKLMMNQLEAY

SEQ ID NO: 853416 - protein, 301 aa, Homo sapiens; identical to SEQ ID NO: 853415

SEQ ID NO: 853417 - protein, 288 aa, Homo sapiens [sequence omitted]

SEQ ID NO: 853418 - protein, 301 aa, Homo sapiens; identical to SEQ ID NO: 853415

SEQ ID NO: 853419 - protein, 183 aa, Homo sapiens
MKSNPVCPTELVKCRLQTMYEMETSGKIAKSQNTVWSVIKSILRKDGPLGFYHGLSSTLLREVPGYFFFFGGYELSRSFFASGRSKDELGPVPLMLSGGVGGICLWLAVYPVDCIKSRIQVLSMSGKQAGFIRTFINVVKNEGITALYSGLKPTMIRAFPANGALFLAYEYSRKLMMNQLEAY

SEQ ID NO: 853420 - protein, 117 aa, Homo sapiens
VSSGVGCLCLPSMDNGTVSLVLEQSSVLIAGGTACVLTGQPFDTMKVKMQTFPDLYRGLTDCCLKTYSQVGFRGFYKGTSPALIANIAENSVLFMCYGFCQQVVRKVAGLDKQAKLR

SEQ ID NO: 853421 - protein, 301 aa, Homo sapiens; identical to SEQ ID NO: 853415

SEQ ID NO: 853422 - protein, 165 aa, Homo sapiens
MYEMETSGKIAKSQNTVWSVIKSILRKDGPLGFYHGLSSTLLREVPGYFFFFGGYELSRSFFASGRSKDELGPVPLMLSGGVGGICLWLAVYPVDCIKSRIQVLSMSGKQAGFIRTFINVVKNEGITALYSGLKPTMIRAFPANGALFLAYEYSRKLMMNQLEAY

SEQ ID NO: 853423 - protein, 356 aa, Homo sapiens
MKSNPAIQAAIDLTAGAAGGTACVLTGQPFDTMKVKMQTFPDLYRGLTDCCLKTYSQVGFRGFYKGTSPALIANIAENSVLFMCYGFCQQVVRKVAGLDKQAKLRLTESPRGRPTVDLQAGCKTTETILSFSSNKLLRSEVGERSGLNSIGWFPHPIKAVDLQNAAAGSFASAFAALVLCPTELVKCRLQTMYEMETSGKIAKSQNTVWSVIKSILRKDGPLGFYHGLSSTLLREVPGYFFFFGGYELSRSFFASGRSKDELGPVPLMLSGGVGGICLWLAVYPVDCIKSRIQVLSMSGKQAGFIRTFINVVKNEGITALYSGLKPTMIRAFPANGALFLAYEYSRKLMMNQLEAY

SEQ ID NO: 853424 - protein, 301 aa, Homo sapiens; identical to SEQ ID NO: 853415

SEQ ID NO: 853425 - protein, 184 aa, Homo sapiens
ALPPPSHAEVNGGTQEGLRAPGHLEGIHEVFYQEEVPQLRGRRDHAGGDLVGQTFRLLPSQGEVHIQGSLDNMTCILVCFPGAPRPSEEAIRRELALDAALGCRIAELCASAQKPPSLNTVFRTLASEDIPDLPPGGGLDCKATVIAEVYSQICQVSEECGEKGQDGAGKSNPTHLGSALDMEA

SEQ ID NO: 853426 - protein, 112 aa, Homo sapiens
MTCILVCFPGAPRPSEEAIRRELALDAALGCRIAELCASAQKPPSLNTVFRTLASEDIPDLPPGGGLDCKATVIAEVYSQICQVSEECGEKGQDGAGKSNPTHLGSALDMEA

SEQ ID NO: 853427 - protein, 112 aa, Homo sapiens; identical to SEQ ID NO: 853426

SEQ ID NO: 853428 - protein, 184 aa, Homo sapiens; identical to SEQ ID NO: 853425

SEQ ID NO: 853429 - protein, 202 aa, Homo sapiens
ALPPPSHAEVNGGTQEGLRAPGHLEGIHEVFYQEEVPQLRGRRDHAGGDLVGQTFRLLPSQGEVHIQGSLDNMTCILVCFPGAPRPSEEAIRRELALDAALGCRIAELCASAQKPPSLNTVFRTLASEDIPDLPPGGGLDCKRGRMGLGSPTPRIWAQPWTWRPDSCCPLGILCFSGASTELKKKTDPFPNYMYQRKEGRPM

SEQ ID NO: 853430 - protein, 202 aa, Homo sapiens; identical to SEQ ID NO: 853429

SEQ ID NO: 853431 - protein, 267 aa, Homo sapiens
RPHGGAEASGGLRFGASAAQGWRARMEDAHCTWLSLPGLPPGWALFAVLDGHGGARAARFGARHLPGHVLQELGPEPSEPEGVREALRRAFLSADERLRSLWPRVETGGCTAVVLLVSPRFLYLAHCGDSRAVLSRAGAVAFSTEDHRPLRPRERERIHAAGGTIRRRRVEGSLAVSRALGDFTYKEAPGRPPELQLVSAEPEVAALARQAEDEFMLLASDGVWDTVSGAAWRDWWLHASAWAWPQSFSARTVVLWGSFASLGPQQN

SEQ ID NO: 853432 - protein, 184 aa, Homo sapiens; identical to SEQ ID NO: 853425

SEQ ID NO: 853433 - protein, 212 aa, Homo sapiens
ALPPPSHAEVNGGTQEGLRAPGHLEGIHEVFYQEEVPQLRGRRDHAGGDLVGQTFRLLPSQGEVHIQGSLDNMTCILVCFPGAPRPSEEAIRRELALDAALGCRIAELCASAQKPPSLNTVFRTLASEDIPDLPPGGGLDCKSARSQKSAERRGRMGLGSPTPRIWAQPWTWRPDSCCPLGILCFSGASTELKKKTDPFPNYMYQRKEGRPM

SEQ ID NO: 853434 - protein, 818 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEQLWTPKKGHTFKLWLSKYCCPQLPNQSNGKKKNEELNDEIKREKTIEPNADWQTLVFRLRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 853435 - protein, 137 aa, Homo sapiens [sequence omitted]

SEQ ID NO: 853436 - protein, 818 aa, Homo sapiens; identical to SEQ ID NO: 853434

SEQ ID NO: 853437 - protein, 818 aa, Homo sapiens; identical to SEQ ID NO: 853434

SEQ ID NO: 853438 - protein, 818 aa, Homo sapiens; identical to SEQ ID NO: 853434

SEQ ID NO: 853439 - protein, 818 aa, Homo sapiens; identical to SEQ ID NO: 853434

SEQ ID NO: 853440 - protein, 398 aa, Homo sapiens [sequence omitted]

SEQ ID NO: 853441 - protein, 786 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEQLWTPKKGHTFKLWLSKYCCPQLPNQSNGKKKNEELNDEIKREKTIEPNADWQTLVFRLRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTGTVI

SEQ ID NO: 853442 - protein, 800 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEQLWTPKKGHTFKLWLSKYCCPQLPNQSNGKKKNEELNDEIKREKTIEPNADWQTLVFRLRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDPDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 853443 - protein, 735 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEQLWTPKKGHTFKLWLSKYCCPQLPNQSNGKKKNEELNDEIKREKTIEPNADWQTLVFRLRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTER

SEQ ID NO: 853444 - protein, 272 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEQLWTPKKGHTFKLWLSKYCCPQLPNQSNGKKKNEE

SEQ ID NO: 853445 - protein, 572 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEQLWTPKKGHTFKLWLSKYCCPQLPNQSNGKKKNEELNDEIKREKTIEPNADWQTLVFRLRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPFLMYSSLHSSVLNKGL

SEQ ID NO: 853446 - protein, 272 aa, Homo sapiens; identical to SEQ ID NO: 853444

SEQ ID NO: 853447 - protein, 760 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 853448 - protein, 831 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEKKAIAACFFFTHRQLWTPKKGHTFKLWLSKYCCPQLPNQSNGKKKNEELNDEIKREKTIEPNADWQTLVFRLRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 853449 - protein, 57 aa, Homo sapiens
MSTVEEDSDTVTVETVNSVTLTQDTEGNLILHCPQNVCGPAVHLLCAVHLLCAVQLS

SEQ ID NO: 853450 - protein, 818 aa, Homo sapiens; identical to SEQ ID NO: 853434

SEQ ID NO: 853451 - protein, 778 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPDGGLSENQCFFLSTHLPSVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 853452 - protein, 140 aa, Homo sapiens
MTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 853453 - protein, 766 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEQLWTPKKGHTFKLWLSKYCCPQLPNQSNGKKKNEELNDEIKREKTIEPNADWQTLVFRLRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEIPYSNIIRKNQISLDHPWAVLFQKIQRMSKIW

SEQ ID NO: 853454 - protein, 108 aa, Homo sapiens
MTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTGTVI

SEQ ID NO: 853455 - protein, 621 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEQLWTPKKGHTFKLWLSKYCCPQLPNQSNGKKKNEELNDEIKREKTIEPNADWQTLVFRLRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSVCYINYLIFEYLL

SEQ ID NO: 853456 - protein, 407 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPGNVLLTF

SEQ ID NO: 853457 - protein, 417 aa, Homo sapiens
KERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 853458 - protein, 157 aa, Homo sapiens
MKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 853459 - protein, 372 aa, Homo sapiens
PEFILSKNMQPTLSDARYKESWRNLRAQGYKLTIEALPFQAARASGDIASDLRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 853460 - protein, 1116 aa, Homo sapiens
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVADTPELLRSKAGAQLQSDVRYTEDYEQQRGKGSFPAMITPAYQIAKRANELASDVRYHQQYQKEMRGMAGPAIGTEGILTRECADQYGQGYPEEYEEHRGKGSFPAMITPAYQNAKKAHELASDIKYRQDFNKMKGAAHYHSLPAQDNLVLKQAQSVNKLVSEVEYKKDLESSRGHSINYCETPQFRNVSKISKFTSDNKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAED

SEQ ID NO: 853461 - protein, 192 aa, Homo sapiens
MICLCSSDLQFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 853462 - protein, 725 aa, Homo sapiens
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVADTPELLRSKAGAQLQSDVRYTEDYEQQRGKGSFPAMITPAYQIAKRANELASDVRYHQQYQKEMRGMAGPAIGTEGILTRECADQYGQGYPEEYEEHRGKGSFPAMITPAYQNAKKAHELASDIKYRQDFNKMKGAAHYHSLPAQDNLVLKQAQSVNKLVSEVEYKKDLESSRGHSINYCETPQFRNVSKISKFTSDNKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEVTCTGASGLQ

SEQ ID NO: 853463 - protein, 282 aa, Homo sapiens
KERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDVRPPCSLLRSLMSFSLVFPVLLKGKPPGPVKIISLSAPKLNMYCILN

SEQ ID NO: 853464 - protein, 1150 aa, Homo sapiens
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVADTPELLRSKAGAQLQSDVRYTEDYEQQRGKGSFPAMITPAYQIAKRANELASDVRYHQQYQKEMRGMAGPAIGTEGILTRECADQYGQGYPEEYEEHRGKGSFPAMITPAYQNAKKAHELASDIKYRQDFNKMKGAAHYHSLPAQDNLVLKQAQSVNKLVSEVEYKKDLESSRGHSINYCETPQFRNVSKISKFTSDNKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDKYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAED

SEQ ID NO: 853465 - protein, 382 aa, Homo sapiens
KERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNEKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 853466 - protein, 843 aa, Homo sapiens
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVADTPELLRSKAGAQLQSDVRYTEDYEQQRGKGSFPAMITPAYQIAKRANELASDVRYHQQYQKEMRGMAGPAIGTEGILTRECADQYGQGYPEEYEEHRGKGSFPAMITPAYQNAKKAHELASDIKYRQDFNKMKGAAHYHSLPAQDNLVLKQAQSVNKLVSEVEYKKDLESSRGHSINYCETPQFRNVSKISKFTSDNKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVHPDS

SEQ ID NO: 853467 - protein, 996 aa, Homo sapiens
SGQSLAAGQKGTWAGCFREGHSVSWPTERVNSEETKRANQRDREGECKGSLGDSGVPVENERQAPRGGPGTWLPEDRAGEEARMWTFVTQLLVTLVLLSFFLVSCQNVMHIVRGSLCFVLKHIHQELDKELGESEGLSDDEETISPRVVRRRVFLKGNEFQNIPGEQVTEEQFTDEQGNIVTKKIIRKVVRQIDLSSADAAQEHEEVELRGSGLQPDLIEGRKGAQIVKRASLKKGETVTPSRSPWSSLSGGSHLDTQPLNPTHFSAMHTGGELDLRATAAVHTFLWADGMTSVRDSCQSPLGMNDCLETHDLQASILPLAMTADLSEPGHKSSKKRGERGIENKRRRACEAKVNEGFLWLGMGFGFGVFFLNCFDFVQGTFSQPHLSEIHVGFLERKKKKEKYDPFHLPMDMVNIRHAKKAQTLASDLDYRKKLHEYIKYKEEYEKTKGKAMGTADSRLLHSLQIAKMSSEVEYKKGFEESKTRFHLPINSRQDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDKYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAED

SEQ ID NO: 853468 - protein, 630 aa, Homo sapiens
PLFSPPPSQHLVPRRVVRRGAPRELAVTMAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 853469 - protein, 87 aa, Homo sapiens
CHPWELEPGNVRGRQGTGWNREAVEHFLEALNMQRKSRGPRGEGGAMSENIWSTLRLALSMLGQSDAYGAADARDLSTLLTMFGLPQ

SEQ ID NO: 853470 - protein, 630 aa, Homo sapiens; identical to SEQ ID NO: 853468

SEQ ID NO: 853471 - protein, 640 aa, Homo sapiens
MGWTPSYLMLASIYDMENSPLFLRNLDFDSTERELAVTMAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 853472 - protein, 602 aa, Homo sapiens
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 853473 - protein, 800 aa, Homo sapiens
PLFSPPPSQHLVPRRVVRRGAPRELAVTMAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEVSHIPLLLCPAELVWKARILLFLPQFSLKRRRRDLRSLQFLSIEQRLKILPLPSSVHSLISLPTNSFFCCLCKSLEPEIPFFLLSTSFRVFSISCLQLEMVRGGVSTGSSWAWLRVHTWKSFPKWPVCVSVPQFLKFVRQIGEGQVSLESGAGSGRAQAEQWAAEFIQQQGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 853474 - protein, 639 aa, Homo sapiens
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFIQQQGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 853475 - protein, 639 aa, Homo sapiens; identical to SEQ ID NO: 853474

SEQ ID NO: 853476 - protein, 630 aa, Homo sapiens; identical to SEQ ID NO: 853468

SEQ ID NO: 853477 - protein, 669 aa, Homo sapiens
MGWTPSYLMLASIYDMENSPLFLRNLDFDSTERELAVTMAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFIQQQGTSDAWVDQFTRPVNTSALDMEFERAKSAIELQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 853478 - protein, 73 aa, Homo sapiens
GFCSVQRAQHYINMPVQFKPKSAGKFEALLVIQTDEGTQLQMAETVLSSTENVILVYGCFEKFVFGCKAALRL

SEQ ID NO: 853479 - protein, 602 aa, Homo sapiens; identical to SEQ ID NO: 853472

SEQ ID NO: 853480 - protein, 639 aa, Homo sapiens; identical to SEQ ID NO: 853474

SEQ ID NO: 853481 - protein, 656 aa, Homo sapiens
MGWTPSYLMLASIYDMENSPLFLRNLDFDSTERELAVTMAMRELVEAECGGANPLMKLAGHFTQDKALRQEGLRPGPWPPGAPASEASVLEVESPGAASEAVMASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 853482 - protein, 630 aa, Homo sapiens; identical to SEQ ID NO: 853468

SEQ ID NO: 853483 - protein, 573 aa, Homo sapiens
PLFSPPPSQHLVPRRVVRRGAPRELAVTMAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHRAHLKLLSPV

SEQ ID NO: 853484 - protein, 74 aa, Homo sapiens
GKCAGAGRGGCGGGNDSPGRSPPVRGHTAHCPGSLREFVEREVIDFARRNPGVVIYVNSRPCCVPRVVAEYRCG

SEQ ID NO: 853485 - protein, 183 aa, Homo sapiens
PEASRFSPAPLSSLLRLRGLQAVAMTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQVQAQ

SEQ ID NO: 853486 - protein, 183 aa, Homo sapiens; identical to SEQ ID NO: 853485

SEQ ID NO: 853487 - protein, 151 aa, Homo sapiens
GKCAGAGRGGCGGGNDSPGRSPPVRGHTAHCPGSLREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQVQAQ

SEQ ID NO: 853488 - protein, 67 aa, Homo sapiens
LTAWVRGWVVSSLLRLRGLQAVAMTARGTPSRFLASVLHNGLGRYVQQLQRLSFSVSRDGASSRGAS

SEQ ID NO: 853489 - protein, 183 aa, Homo sapiens; identical to SEQ ID NO: 853485

SEQ ID NO: 853490 - protein, 183 aa, Homo sapiens; identical to SEQ ID NO: 853485

SEQ ID NO: 853491 - protein, 226 aa, Homo sapiens
PEASRFSPAPLSSLLRLRGLQAVAMTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDTGLRLSAVAPQILLPGWPDPISVQSSDLPWGNTHYRPEPLSSTTWL

SEQ ID NO: 853492 - protein, 235 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDAAEFLGEGAGPCWYSIVALPQKHIAIAIHPPQPAGQCHQAIGHWPETVCSCTADPPARLARPNISSVIRSSLGKYPLPS

SEQ ID NO: 853493 - protein, 268 aa, Homo sapiens
PEASRFSPAPLSSLLRLRGLQAVAMTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDAAEFLGEGAGPCWYSIVALPQKHIAIAIHPPQPAGQCHQAIGQLSRWRWGRWGWWGWGSLPRDDLETAALQAPSPLIITLIFLSRTLA

SEQ ID NO: 853494 - protein, 184 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDTGLRLSAVAPQILLPGWPDPTRATRATR

SEQ ID NO: 853495 - protein, 144 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRSGTPSPTSRPRSAGYAPERFRILPQPRTLA

SEQ ID NO: 853496 - protein, 109 aa, Homo sapiens
GKCAGAGRGGCGGGNDSPGRSPPVRGHTAHCPGSLREFVEREVIDFARRNPGVVIYVNSRPCCVPRVVAEYRHWPETVCSCTADPPARLARPNISSVIRSSLGKYPLPS

SEQ ID NO: 853497 - protein, 183 aa, Homo sapiens; identical to SEQ ID NO: 853485

SEQ ID NO: 853498 - protein, 197 aa, Homo sapiens
MTARGTPSRFLASVLHNGLGRYVQQLQRLSFSVSRDGASSRGAREFVEREVIDFARRNPGVVIYVNSRPCCVPRVVAEYREWGRARAGGRDQGLDPLSSFSLGRTGQLPPTLTPLLPVNGAVREESIHCKSVEEISTLVQKLADQSGLDVIRIRKPFHTDNPSIQGQWHPFTNKPTTFRGLRPREVQDPAPAQVQAQ

SEQ ID NO: 853499 - protein, 183 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRSGTPSPTSRPRSAGYAPERFRILPQPRCKHSEELPHQLQPQALDCYSGKGGSSPLGFQAQANGTHQWAS

SEQ ID NO: 853500 - protein, 188 aa, Homo sapiens
PEASRFSPAPLSSLLRLRGLQAVAMTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQCLLLGAVTL

SEQ ID NO: 853501 - protein, 183 aa, Homo sapiens; identical to SEQ ID NO: 853485

SEQ ID NO: 853502 - protein, 268 aa, Homo sapiens; identical to SEQ ID NO: 853493

SEQ ID NO: 853503 - protein, 285 aa, Homo sapiens
PEASRFSPAPLSSLLRLRGLQAVAMTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDAAEFLGEGAGPCWYSIVALPQKHIAIAIHPPQPAGQCHQAIGHWPETVCSCTADPPARLARPTRPPHSGSYLILIDLCSSPYAVRSFLPPDCPCTDHCVLSVKAA

SEQ ID NO: 853504 - protein, 117 aa, Homo sapiens
MTARGTPSRFLASVLHNGLGRYVQQLQRLSFSVSRDGASSRGAREFVEREVIDFARRNPGVVIYVNSRPCCVPRVVAEYRHWPETVCSCTADPPARLARPNISSVIRSSLGKYPLPS

SEQ ID NO: 853505 - protein, 123 aa, Homo sapiens
FCRDRVSPCCLGWSPTWSPGLKRSARLGLPQCWDSRRELPRPAYLLFLLSWGSPSPSAWQEGGGARRKEVQNTQRCPRFRLALALLPPSSNKARETSAGNWPAVMGEAKKTGVQWHDQGSLQP

SEQ ID NO: 853506 - protein, 174 aa, Homo sapiens
FCRDRVSPCCLGWSPTWSPGLKRSARLGLPQCWDSRRELPRPAYLLFLLSWGSPSPSAWQEGGGARRKEVQNTQRCPRFRLALALLPPSSNKARETSAGNWPAVMGEAKKTGEQRVRLPRTALGSRRDPERGSSPHFVAALLRSMPCLSHSSWLPGKRKHLELARSYQRLSTPG

SEQ ID NO: 853507 - protein, 164 aa, Homo sapiens
FCRDRVSPCCLGWSPTWSPGLKRSARLGLPQCWDSRRELPRPAYLLFLLSWGSPSPSAWQEGGGARRKEVQNTQRCPRFRLALALLPPSSNKARETSAGNWPAVMGEAKKTALGSRRDPERGSSPHFVAALLRSMPCLSHSSWLPGKRKHLELARSYQRLSTPG

SEQ ID NO: 853508 - protein, 376 aa, Homo sapiens
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 853509 - protein, 263 aa, Homo sapiens
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGMLNTHIFSTFC

SEQ ID NO: 853510 - protein, 252 aa, Homo sapiens [sequence omitted]

SEQ ID NO: 853511 - protein, 340 aa, Homo sapiens
MHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 853512 - protein, 404 aa, Homo sapiens
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFKYRGYTCRFVTWEYCVMLRFGVWIPSSRYELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 853513 - protein, 167 aa, Homo sapiens
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNSPLMGAWVDSMSLLFCIVLQ

SEQ ID NO: 853514 - protein, 102 aa, Homo sapiens
MWTEIFIFCLRIYEVYHIRGLKQGVYFVILKLFCIWTNTKYPSGLFFFFLNLCIHLILLRIPSKQKNLLCHLHYSNYRLKKYGQFLKKFRLCFPWKDKSDCS

SEQ ID NO: 853515 - protein, 102 aa, Homo sapiens; identical to SEQ ID NO: 853514

SEQ ID NO: 853516 - protein, 102 aa, Homo sapiens; identical to SEQ ID NO: 853514

SEQ ID NO: 853517 - protein, 193 aa, Homo sapiens
MAAPLGGMFSGQPPGPPQAPPGLPGQASLLQAAPGAPRPSSSTLVDELESSFEACFASLVSQDYVNGTDQEEIRTGVDQCIQKFLDIARQTECFFLQKRLQLSVQKPEQVIKEDVSELRNELQRKDALVQKHLTKLRHWQQVLEDINVQHKKPADIPQGSLAYLGAGICQHPCTSEANVSKGQRQLAYEWADA

SEQ ID NO: 853518 - protein, 193 aa, Homo sapiens; identical to SEQ ID NO: 853517

SEQ ID NO: 853519 - protein, 193 aa, Homo sapiens; identical to SEQ ID NO: 853517

SEQ ID NO: 853520 - protein, 193 aa, Homo sapiens; identical to SEQ ID NO: 853517

SEQ ID NO: 853521 - protein, 193 aa, Homo sapiens; identical to SEQ ID NO: 853517

SEQ ID NO: 853522 - protein, 193 aa, Homo sapiens; identical to SEQ ID NO: 853517

SEQ ID NO: 853523 - protein, 193 aa, Homo sapiens; identical to SEQ ID NO: 853517

SEQ ID NO: 853524 - protein, 72 aa, Homo sapiens
RPLQSTELCPGGGARVVAVAALLGRLVWCEERQARAEGPSGSPAAAFSHCVCVRTLEPSGEWVFVFPSLLRI

SEQ ID NO: 853525 - protein, 286 aa, Homo sapiens
RSIAAELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 853526 - protein, 286 aa, Homo sapiens; identical to SEQ ID NO: 853525

SEQ ID NO: 853527 - protein, 182 aa, Homo sapiens
EKAGEAGPAVFLQAGSLLAVEDQAVQERKGSGGRAGPQQVQTSMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 853528 - protein, 297 aa, Homo sapiens
DAFLLLRNNSIQNRQLLAEQLADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 853529 - protein, 297 aa, Homo sapiens; identical to SEQ ID NO: 853528

SEQ ID NO: 853530 - protein, 103 aa, Homo sapiens
EYLCAGVCVCVLCVCVCPVLGERSVAFEEVREKNHGTSGFLSLYSLAAIVCGHLMFFHTLLGRGGNDHPGQSPLPGMRPLRGGLAGQAPSGHPWMQPLDTCLL

SEQ ID NO: 853531 - protein, 286 aa, Homo sapiens; identical to SEQ ID NO: 853525

SEQ ID NO: 853532 - protein, 297 aa, Homo sapiens; identical to SEQ ID NO: 853528

SEQ ID NO: 853533 - protein, 139 aa, Homo sapiens
MKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 853534 - protein, 297 aa, Homo sapiens; identical to SEQ ID NO: 853528

SEQ ID NO: 853535 - protein, 661 aa, Homo sapiens
GPRGGASARGPLLLRGVAAGGWRSPAGPRGGASAGDRCSSGAWLLPSISQLSRARAQATLCSSRRLLYPTASGAIPRLLALSFRPLPASGPASPLPTAPPILPTLLPQTSDRHPCLVPFSPFLPLHLLSPTPLGSLFSQNPGLSAWPRLQAGDVPRGPAPMVLTLLLSAYKLCRFFAIRAHGRAPSGWRCLGQMGAVARAHGGLRVARARESVAGGRHRGAGRPGARAAGAAAGLVRAEAGGRRAGRGRRPGRGLPTGGGGLAAAAVGREVAQGLCDAIRLDGGLDLLLRLLQAPELETRVQAARLLEQILVAENRLSAPGRGWESAAWCGQLSACVPVCLAPCLCLPHLSDCLHYISVRGQPVCFTDKETEPWESLVTCSVDHSELRFAPRASGVRNGVTGQESVPGSMDGDGILLPILPLPRPPSPQLSFPPAWVPVYDTFSRHHPIPLPMREEGKHNAQKRGRETSPFPPPQAVRRAGLRLLTPFLPPQSNFCSILSFWFLQQARHDLILQLLMGNSFLLGGMGGGRGHRGAEPGGDQAECVFSPFTPLSTKMPQEGQTEAWLPLLHVSWDLSWSMKTSKDSLSLPSDARADQAVTLQSHAEVSSFSSLEEFLEESLSAHAALTSVKGVGWGCFPCHFRKEKNYLVIGGKIQLSKMHE

SEQ ID NO: 853536 - protein, 136 aa, Homo sapiens [sequence omitted]

SEQ ID NO: 853537 - protein, 118 aa, Homo sapiens
WGQGCGTDTGLTCSLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIK

SEQ ID NO: 853538 - protein, 841 aa, Homo sapiens
GPRGGASARGPLLLRGVAAGGWRSPAGPRGGASAGDRCSSGAWLLPSISQLSRARAQATLCSSRRLLYPTASGAIPRLLALSFRPLPASGPASPLPTAPPILPTLLPQTSDRHPCLVPFSPFLPLHLLSPTPLGSLFSQNPGLSAWPRLQAGDVPRGPAPMVLTLLLSAYKLCRFFAIRAHGRAPSGWRCLGQMGAVARAHGGLRVARARESVAGGRHRGAGRPGARAAGAAAGLVRAEAGGRRAGRGRRPGRGLPTGGGGLAAAAVGREVAQGLCDAIRLDGGLDLLLRLLQAPELETRVQAARLLEQILVAENRDRVARIGLGVILNLAKEREPVELARSVAGILEHMFKHSEETCQRLVAAGGLDAVLYWCRRTDPALLRHCALALGNCALHGGQAVQRRMVEKRAAEWLFPLAFSKEDELLRLHACLAVAVLATNKEVEREVERSGTLALVEPLVASLDPGRFARCLVDASDTSQGRGPDDLQRLVPLLDSNRLEAQCIGAFYLCAEAAIKSLQGKTKVFSDIGAIQSLKRLVSYSTNGTKSALAKRALRLLGEEVPRPILPSVPSWKEAEVQTWLQQIGFSKYCESFREQQVDGDLLLRLTEEELQTDLGMKSGITRKRFFRELTELKTFANYSTCDRSNLADWLGSLDPRFRQYTYGLVSCGLDRSLLHRVSEQQLLEDCGIHLGVHRARILTAAREMLHSPLPCTGGKPSGDTPDVFISYRRNSGSQLASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIK

SEQ ID NO: 853539 - protein, 841 aa, Homo sapiens; identical to SEQ ID NO: 853538

SEQ ID NO: 853540 - protein, 883 aa, Homo sapiens
GPRGGASARGPLLLRGVAAGGWRSPAGPRGGASAGDRCSSGAWLLPSISQLSRARAQATLCSSRRLLYPTASGAIPRLLALSFRPLPASGPASPLPTAPPILPTLLPQTSDRHPCLVPFSPFLPLHLLSPTPLGSLFSQNPGLSAWPRLQAGDVPRGPAPMVLTLLLSAYKLCRFFAIRAHGRAPSGWRCLGQMGAVARAHGGLRVARARESVAGGRHRGAGRPGARAAGAAAGLVRAEAGGRRAGRGRRPGRGLPTGGGGLAAAAVGREVAQGLCDAIRLDGGLDLLLRLLQAPELETRVQAARLLEQILVAENRDRVARIGLGVILNLAKEREPVELARSVAGILEHMFKHSEETCQRLVAAGGLDAVLYWCRRTDPALLRHCALALGNCALHGGQAVQRRMVEKRAAEWLFPLAFSKEDELLRLHACLAVAVLATNKEVEREVERSGTLALVEPLVASLDPGRFARCLVDASDTSQGRGPDDLQRLVPLLDSNRLEAQCIGAFYLCAEAAIKSLQGKTKVFSDIGAIQSLKRLVSYSTNGTKSALAKRALRLLGEEVPRPILPSVPSWKEAEVQTWLQQIGFSKYCESFREQQVDGDLLLRLTEEELQTDLGMKSGITRKRFFRELTELKTFANYSTCDRSNLADWLGSLDPRFRQYTYGLVSCGLDRSLLHRVSEQQLLEDCGIHLGVHRARILTAAREMLHSPLPCTGGKPSGDTPDVFISYRRNSGSQLASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIKWSHEYQEATIEKIIRFLQGRSSRDSSAGSDTSLEGAAPMGPT

SEQ ID NO: 853541 - protein, 841 aa, Homo sapiens; identical to SEQ ID NO: 853538

SEQ ID NO: 853542 - protein, 841 aa, Homo sapiens; identical to SEQ ID NO: 853538

SEQ ID NO: 853543 - protein, 841 aa, Homo sapiens; identical to SEQ ID NO: 853538

SEQ ID NO: 853544 - protein, 841 aa, Homo sapiens; identical to SEQ ID NO: 853538

SEQ ID NO: 853545 - protein, 141 aa, Homo sapiens
VLIGTGKGLPRIGAADSSAQSSRMALGVWMPLELHIQLLYERKKLEDNKGSERREKAVLNKVLAVSGAGLLPSGLRDIECCFAKSCFLEPLQGSPIWTLLQIPCPGSPPVAKAQATVWARAHIGFETFQNKMPVYLLLSGI

SEQ ID NO: 853546 - protein, 120 aa, Homo sapiens
VLIGTGKGLPRIGAADSSAQSSRMALGVWMPLELHIQLLYERKKLEDNKGSERREKAVLNKVLAVSGAGLLPSGLRDIECCFAKSCFLEPLQGSPIWTLLQIPCPGQQLLNQKDQLNIFP

SEQ ID NO: 853547 - protein, 102 aa, Homo sapiens
SSVLIGTGKGLPRIGAADSSAQSSRMALGVWMPLELHIQLLYERKKLEDNKGRVLFQARVKERNADNEPQPSTSGVTTSQPENDVVPSYYLFSTAFDHSKHV

SEQ ID NO: 853548 - protein, 597 aa, Homo sapiens
QSLANSLPSKAQPGAEMAASGRGLCKAVAASPFPAWRRDNTEARGGLKPEYDAVVIGAGHNGLVAAAYLQRLGVNTAVFERRHVIGGAAVTEEIIPGFKFSRASYLLSLLRPQIYTDLELKKHGLRLHLRNPYSFTPMLEEGAGSKVPRCLLLGTDMAENQKQIAQFSQKDAQVFPKYEEFMHRLALAIDPLLDAAPVDMAAFQHGSLLQRMRSLSTLKPLLKAGRILGAQLPRYYEVLTAPITKVLDQWFESEPLKATLATDAVIGAMTSPHTPGSGYVLLHHVMGGLEGMQGAWGYVQGGMGALSDAIASSATTHGASIFTEKTVAKVQVNSEGCVQGVVLEDGTEVRSKMVLSNTSPQITFLKLTPQEWLPEEFLERISQLDTRSPVTKINVAVDRLPSFLAAPNAPRGQPLPHHQCSIHLNCEDTLLLHQAFEDAMDGLPSHRPVIELCIPSSLDPTLAPPGCHVVSLFTQYTPYTLAGGKAWDEQERDAYADRVFDCIEVYAPGFKDSVVGRDILTPPDLERIFGLPGGNIFHCAMSLDQLYFARPVPLHSGYRCPLQGLYLCGSGAHPGGGVMGAAGRNAAHVAFRDLKSM

SEQ ID NO: 853549 - protein, 509 aa, Homo sapiens
QSLANSLPSKAQPGAEMAASGRGLCKAVAASPFPAWRRDNTEARGGLKPEYDAVVIGAGHNGLVAAAYLQRLGVNTAVFERRHVIGGAAVTEEIIPGFKFSRASYLLSLLRPQIYTDLELKKHGLRLHLRNPYSFTPMLEEGAGSKVPRCLLLGTDMAENQKQIAQFSQKDAQVFPKYEEFMHRLALAIDPLLDAAPVDMAAFQHGSLLQRMRSLSTLKPLLKAGRILGAQLPRYYEVLTAPITKVLDQWFESEPLKATLATDAVIGAMTSPHTPGSGYVLLHHVMGGLEGMQGAWGYVQGGMGALSDAIASSATTHGASIFTEKTVAKVQVNSEGCVQGVVLEDGTEVRSKMVLSNTSPQITFLKLTPQEWLPEEFLERISQLDTRSPVTKINVAVDRLPSFLAAPNAPRGQPLPHHQCSIHLNCEDTLLLHQAFEDAMDGLPSHRPVIELCIPSSLDPTLAPPGCHVVSLFTQYTPYTLAGGKAWDEQERDAYADRAQLTARTKGEA

SEQ ID NO: 853550 - protein, 187 aa, Homo sapiens
QSLANSLPSKAQPGAEMAASGRGLCKAVAASPFPAWRRDNTEARGGLKPEYDAVVIGAGHNGLVAAAYLQRLGVNTAVFERRHVIGGAAVTEEIIPGFKFSRASYLLSLLRPQIYTDLELKVGPPRRPDCTEGGGSSIFPTCVGGPCSVPEVMPAPEGSLFHPSLVYPTWSPCCIPTDGFCLVHVVS

SEQ ID NO: 853551 - protein, 155 aa, Homo sapiens
MHSGVWGQASSSQVLWTTLAAAKPVQVDNHCGCRATIAQNWCHLSASTVSQVISDALPSALLLFRPAVSSLPAQPVIELCIPSSLDPTLAPPGCHVVSLFTQYTPYTLAGGKAWDEQERDAYADRGKDSCTFCLQSHSRACDPTGPAPPHCPIQD

SEQ ID NO: 853552 - protein, 503 aa, Homo sapiens
QSLANSLPSKAQPGAEMAASGRGLCKAVAASPFPAWRRDNTEARGGLKPEYDAVVIGAGHNGLVAAAYLQRLGVNTAVFERRHVIGGAAVTEEIIPGFKFSRASYLLSLLRPQIYTDLELKKHGLRLHLRNPYSFTPMLEEGAGSKVPRCLLLGTDMAENQKQIAQFSQKDAQVFPKYEEFMHRLALAIDPLLDAAPVDMAAFQHGSLLQRMRSLSTLKPLLKAGRILGAQLPRYYEVLTAPITKVLDQWFESEPLKATLATDAVIGAMTSPHTPGSGYVLLHHVMGGLEGMQGAWGYVQGGMGALSDAIASSATTHGASIFTEKTVAKVQVNSEGCVQGVVLEDGTEVRSKMVLSNTSPQITFLKLTPQEWLPEEFLERISQLDTRSPVTKINAGASIFTEKTVAKVQVNMKAVFKDSVVGRDILTPPDLERIFGLPGGNIFHCAMSLDQLYFARPVPLHSGYRCPLQGLYLCGSGAHPGGGVMGAAGRNAAHVAFRDLKSM

SEQ ID NO: 853553 - protein, 128 aa, Homo sapiens
QSLANSLPSKAQPGAEMAASGRGLCKAVAASPFPAWRRDNTEARGGLKPEYDAVVIGAGHNGLVAAAYLQRLGVNTAVFERRHVIGGAAVTEEIIPGFKFSRASYLLSLLRPQIYTDLELKVSPPAGW

SEQ ID NO: 853554 - protein, 615 aa, Homo sapiens [sequence omitted]

SEQ ID NO: 853555 - protein, 615 aa, Homo sapiens [sequence omitted]

SEQ ID NO: 853556 - protein, 213 aa, Homo sapiens [sequence omitted]

SEQ ID NO: 853557 - protein, 615 aa, Homo sapiens [sequence omitted]

SEQ ID NO: 853558 - protein, 615 aa, Homo sapiens [sequence omitted]

SEQ ID NO: 853559 - protein, 615 aa, Homo sapiens [sequence omitted]

SEQ ID NO: 853560 - protein, 615 aa, Homo sapiens [sequence omitted]

SEQ ID NO: 853561 - protein, 535 aa, Homo sapiens
MPSRKFADGEVVRGRWPGSSLYYEVEILSHDSTSQLYTVKYKDGTELELKENDIKPLTSFRQRKGGSTSSSPSRRRGSRSRSRSRSPGRPPKSARRSASASHQADIKEARREVEVKLTPLILKPFGNSISRYNGEPEHIERNDAPHKNTQEKFNLSQESSYIATQYSLRPRREEVKLKEIDSKEEKYVAKELAVRTFEVTPIRAKDLEFGGVPGVFLIMFGLPVFLFLLLLMCKQKDPSLLNFPPPLPALYELWETRVFGVYLLWFLIQVLFYLLPIGKVVEGTPLIDGRRLKYRLNGFYAFILTSAVIGTSLFQGVEFHYVYSHFLQFALAATVFCVVLSVYLYMRSLKAPRNDLSPASSGNAVYDFFIGRELNPRIGTFDLKYFCELRPGLIGWVVINLVMLLAEMKIQDRAVPSLAMILVNSFQLLYVVDALWNEEALLTTMDIIHDGFGFMLAFGDLVWVPFIYSFQAFYLVSHPNEVSWPMASLIIVLKLCGYVIFRGANSQKNAFRKNPSDPKLAHVRPSYFTGKILEV

SEQ ID NO: 853562 - protein, 414 aa, Homo sapiens [sequence omitted]

SEQ ID NO: 853563 - protein, 283 aa, Homo sapiens [sequence omitted]

SEQ ID NO: 853564 - protein, 85 aa, Homo sapiens
QGDLGKLGELGELGEQGDPGELVEVEELARACCLFGGPACGGRQQFFFFAGGRRARNEEMCINYEDRCFDCDGLLEWIHQSLSSF

SEQ ID NO: 853565 - protein, 615 aa, Homo sapiens [sequence omitted]

SEQ ID NO: 853566 - protein, 615 aa, Homo sapiens [sequence omitted]

SEQ ID NO: 853567 - protein, 107 aa, Homo sapiens
VSTSLKMYFYFYIDLKTIHTSTGKNLLVSGWWGFVRHPNYLGDLIMALAWSLPCGFNHILPYFYIIYFTMLLVHREARDEYHCKKKYGVAWEKYCQRVPYRIFPYIY

SEQ ID NO: 853568 - protein, 615 aa, Homo sapiens [sequence omitted]

SEQ ID NO: 853569 - protein, 497 aa, Homo sapiens
MPSRKFADGEVVRGRWPGSSLYYEVEILSHDSTSQLYTVKYKDGTELELKENDIKPLTSFRQRKGGSTSSSPSRRRGSRSRSRSRSPGRPPKSARRSASASHQADIKEARREVEVKLTPLILKPFGNSISRYNGEPEHIERNDAPHKNTQEKFNLSQESSYIATQYSLRPRREEVKLKEIDSKEEKYVAKELAVRTFEVTPIRAKDLEFGGVPGVFLIMFGLPVFLFLLLLMCKQKDPSLLNFPPPLPALYELWETRVFGVYLLWFLIQVLFYLLPIGKVVEGTPLIDGRRLKYRLNGFYAFILTSAVIGTSLFQGVEFHYVYSHFLQFALAATVFCVVLSVYLYMRSLKAPRNDLSPASSGNAVYDFFIGRELNPRIGTFDLKYFCELRPGLIGWVVINLVMLLAEMKIQDRAVPSLAMILVNSFQLLYVVDALWNEEALLTTMDIIHDGFGFMLAFGDLVWVPFIYSFQAFYLVSHPNEVSWPMASLIIVLKREY

SEQ ID NO: 853570 - protein, 321 aa, Homo sapiens
MPSRKFADGEVVRGRWPGSSLYYEVEILSHDSTSQLYTVKYKDGTELELKENDIKPLTSFRQRKGGSTSSSPSRRRGSRSRSRSRSPGRPPKSARRSASASHQADIKEARREVEVKLTPLILKPFGNSISRYNGEPEHIERNDAPHKNTQEKFNLSQESSYIATQYSLRPRREEVKLKEIDSKEEKYVAKELAVRTFEVTPIRAKDLEFGGVPGVFLIMFGLPVFLFLLLLMCKQKDPSLLNFPPPLPALYELWETRVFGVYLLWFLIQVLFYLLPIGKVVEGTPLTDGSKTQSCSHQSHQPRHLCNPRWTAVLITYRGHV

SEQ ID NO: 853571 - protein, 364 aa, Homo sapiens [sequence omitted]

SEQ ID NO: 853572 - protein, 117 aa, Homo sapiens
RRPIAVVLTVAVGLTVASRVTVVSGLTWLEKAWNSIIDVYHKYSLIKGNFHAVYRDDLKKLLETECPQYIRKKGADVWFKELDINTDGAVNFQEFLILVIKMGVAAHKKSHEESHKE

SEQ ID NO: 853573 - protein, 84 aa, Homo sapiens
RPPTTTTKFAAASTGNFHAVYRDDLKKLLETECPQYIRKKGADVWFKELDINTDGAVNFQEFLILVIKMGVAAHKKSHEESHKE

SEQ ID NO: 853574 - protein, 94 aa, Homo sapiens
MLTELEKALNSIIDVYHKYSLIKGNFHAVYRDDLKKLLETECPQYIRKKGADVWFKELDINTDGAVNFQEFLILVIKMGWQPTKKAMKKATKSS

SEQ ID NO: 853575 - protein, 94 aa, Homo sapiens; identical to SEQ ID NO: 853574

SEQ ID NO: 853576 - protein, 110 aa, Homo sapiens
MSLCEWTLPLPTRVSLSSHPSHQSHSHLLVWLFGECRPGQGHRLGHESSAYCPGQMQIPCHGIPQKVLFFRWGKSVGIMLTELEKALELYHRRLPQVLPDKGEFPCRLQG

SEQ ID NO: 853577 - protein, 66 aa, Homo sapiens
RRQHDAHGLAPPEKQNLQVFLKDSLQEWGKSVGIMLTELEKALELYHRRLPQVLPDKGEFPCRLQG

SEQ ID NO: 853578 - protein, 94 aa, Homo sapiens; identical to SEQ ID NO: 853574

SEQ ID NO: 853579 - protein, 94 aa, Homo sapiens; identical to SEQ ID NO: 853574

SEQ ID NO: 853580 - protein, 94 aa, Homo sapiens; identical to SEQ ID NO: 853574

SEQ ID NO: 853581 - protein, 97 aa, Homo sapiens
SHPMYGYELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 853582 - protein, 110 aa, Homo sapiens; identical to SEQ ID NO: 853576

SEQ ID NO: 853583 - protein, 134 aa, Homo sapiens
MSLCEWTLPLPTRVSLSSHPSHQSHSHLLVWLFGECRPGQGHRLGHESSAYCPGQMQIPCHGIPQKVLFFRWGKSVGIMLTELEKALELYHRRLPQVLPDKGEFPCSTPELTKGIGITLCTRYTRVHVQMPQIN

SEQ ID NO: 853584 - protein, 100 aa, Homo sapiens
RPPTTTKFAAASTKTWNSIIDVYHKYSLIKGNFHAVYRDDLKKLLETECPQYIRKKGADVWFKELDINTDGAVNFQEFLILVIKMGVAAHKKSHEESHKE

SEQ ID NO: 853585 - protein, 72 aa, Homo sapiens
PEAVEQLAKPNRYKKELPLSPACLLSAVFQKTWWGKSVGIMLTELEKALELYHRRLPQVLPDKGEFPCRLQG

SEQ ID NO: 853586 - protein, 66 aa, Homo sapiens; identical to SEQ ID NO: 853577

SEQ ID NO: 853587 - protein, 76 aa, Homo sapiens
GRLLLLLNSRPRRRDDLKKLLETECPQYIRKKGADVWFKELDINTDGAVNFQEFLILVIKMGVAAHKKSHEESHKE

SEQ ID NO: 853588 - protein, 94 aa, Homo sapiens; identical to SEQ ID NO: 853574

SEQ ID NO: 853589 - protein, 94 aa, Homo sapiens; identical to SEQ ID NO: 853574

SEQ ID NO: 853590 - protein, 94 aa, Homo sapiens; identical to SEQ ID NO: 853574

SEQ ID NO: 853591 - protein, 94 aa, Homo sapiens; identical to SEQ ID NO: 853574

SEQ ID NO: 853592 - protein, 94 aa, Homo sapiens; identical to SEQ ID NO: 853574

SEQ ID NO: 853593 - protein, 1139 aa, Homo sapiens
MPSGGDQSPPPPPPPPAAAASDEEEEDDGEAEDAAPPAESPTPQIQQRFDELCSRLNMDEAARAEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 853594 - protein, 923 aa, Homo sapiens
MISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 853595 - protein, 401 aa, Homo sapiens
LRVFFFSLSLGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 853596 - protein, 171 aa, Homo sapiens [sequence omitted]

SEQ ID NO: 853597 - protein, 571 aa, Homo sapiens
MPSGGDQSPPPPPPPPAAAASDEEEEDDGEAEDAAPPAESPTPQIQQRFDELCSRLNMDEAARAEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVFLKI

SEQ ID NO: 853598 - protein, 80 aa, Homo sapiens
HFVCICFSYSKAINKAYEEYVLSVGNLDERIFLGEDAEEEIGTLSRCLNAGSGTETAERVQMKNILQQHFDKVSLAMPEE

SEQ ID NO: 853599 - protein, 1139 aa, Homo sapiens; identical to SEQ ID NO: 853593

SEQ ID NO: 853600 - protein, 1139 aa, Homo sapiens; identical to SEQ ID NO: 853593

SEQ ID NO: 853601 - protein, 1115 aa, Homo sapiens
MPSGGDQSPPPPPPPPAAAASDEEEEDDGEAEDAAPPAESPTPQIQQRFDELCSRLNMDEAARAEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 853602 - protein, 1112 aa, Homo sapiens
MPSGGDQSPPPPPPPPAAAASDEEEEDDGEAEDAAPPAESPTPQIQQRFDELCSRLNMDEAARAEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKVSLTSILAFTNLKMLQMLETGFVLSLGTH

SEQ ID NO: 853603 - protein, 626 aa, Homo sapiens
MPSGGDQSPPPPPPPPAAAASDEEEEDDGEAEDAAPPAESPTPQIQQRFDELCSRLNMDEAARAEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEELFTF

SEQ ID NO: 853604 - protein, 366 aa, Homo sapiens
MMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 853605 - protein, 71 aa, Homo sapiens
MALVDKHKVKRQRLDRICEEFIVASCTQTPASSPKFLEDCFAFDLRVAKFHKEWPLLDKHKVKRQRLDRIV

SEQ ID NO: 853606 - protein, 985 aa, Homo sapiens
MPVPSRHINIGRSQSWDAAGWYEGPWENAESLRPLGRRSSLTYGTAEGTWFEPNHRPQDAALPVAAEPYLYREAVYNSVAARKGSTPDFTFYDSRQAVMSGRSPLLPREYYSDPSGAARVPKEPPLYRDPGVSRPVPSYGVLGSRTSWDPMQGRSPALQDAGHLYRDPGGKMIPQGRQTQSRAASPGRYGREQPDTRYGAEVPAYPLSQVFSDISERPIDPAPARQVAPTCLVVDPSSAAAPEGSTGVAPGALNRGYGPARESIPSKMAYETYEADLSTFQGPGGKRTVLPEFLAFLRAEGLAEATLGALLQQGFDSPAVLATLEDADIKSVAPNLGQARVLSRLANSCRTEMQLRRQDRGGPLPRARSSSFSHRSELLHGDLASLGAAAPLQTASPRAGDPARRPSSAPSQHLLETAATYSAPGVGTHAPHFPSNSGYSSPTPCALTARLSPTHPLQAGVALTNPGPSNPLHPGPRTAYSTAYTVPMELLKRERNVAASPLPSPHGSPQVLRKPGAPLGPSTLPPASQSLHTPHSPYQKVARRTGAPIIVSTMLAPEPSIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 853607 - protein, 445 aa, Homo sapiens
MALVDKHKVKRQRLDRICEGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 853608 - protein, 445 aa, Homo sapiens; identical to SEQ ID NO: 853607

SEQ ID NO: 853609 - protein, 445 aa, Homo sapiens; identical to SEQ ID NO: 853607

SEQ ID NO: 853610 - protein, 445 aa, Homo sapiens; identical to SEQ ID NO: 853607

SEQ ID NO: 853611 - protein, 513 aa, Homo sapiens
MRPGLPGPTGLCAQTSSRGQKSVLKQKESCGIWQLYHFLSRKQEPRWEPCVSGSSSGDGAVADLADELRGYPALCCTLPVHSYRSWAGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 853612 - protein, 366 aa, Homo sapiens; identical to SEQ ID NO: 853604

SEQ ID NO: 853613 - protein, 985 aa, Homo sapiens; identical to SEQ ID NO: 853606

SEQ ID NO: 853614 - protein, 380 aa, Homo sapiens
MALVDKHKVKRQRLDRICEGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPVT

SEQ ID NO: 853615 - protein, 445 aa, Homo sapiens; identical to SEQ ID NO: 853607

SEQ ID NO: 853616 - protein, 386 aa, Homo sapiens
MALVDKHKVKRQRLDRICEGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYR

SEQ ID NO: 853617 - protein, 246 aa, Homo sapiens
MWVMTGLGSDRRSRLRMDYVTDCYKSAYLSYLRSYMKIIVSAIWGVCECEPESYKSTLISTWNTPSGRNTVVSCEGYISITFRFLLTSGSYFRLECANTASDQITLLASTTYFSVNTCLIQYCFRDTTLHCHKLAVSDSCKPMPKHIGTFCVTVYGRVLATKVKRHRTRMVTDVYHPQRHAAPRARAPMTASHKFTTTSTNSLNTTEDPGTADTERRPSQTPEKRGTQGGHYQQKAITTANKKTAD

SEQ ID NO: 853618 - protein, 985 aa, Homo sapiens; identical to SEQ ID NO: 853606

SEQ ID NO: 853619 - protein, 723 aa, Homo sapiens
MPVPSRHINIGRSQSWDAAGWYEGPWENAESLRPLGRRSSLTYGTAEGTWFEPNHRPQDAALPVAAEPYLYREAVYNSVAARKGSTPDFTFYDSRQAVMSGRSPLLPREYYSDPSGAARVPKEPPLYRDPGVSRPVPSYGVLGSRTSWDPMQGRSPALQDAGHLYRDPGGKMIPQGRQTQSRAASPGRYGREQPDTRYGAEVPAYPLSQVFSDISERPIDPAPARQVAPTCLVVDPSSAAAPEGSTGVAPGALNRGYGPARESIPSKMAYETYEADLSTFQGPGGKRTVLPEFLAFLRAEGLAEATLGALLQQGFDSPAVLATLEDADIKSVAPNLGQARVLSRLANSCRTEMQLRRQDRGGPLPRARSSSFSHRSELLHGDLASLGAAAPLQTASPRAGDPARRPSSAPSQHLLETAATYSAPGVGTHAPHFPSNSGYSSPTPCALTARLSPTHPLQAGVALTNPGPSNPLHPGPRTAYSTAYTVPMELLKRERNVAASPLPSPHGSPQVLRKPGAPLGPSTLPPASQSLHTPHSPYQKVARRTGAPIIVSTMLAPEPSAAPRMTEAGHLVVPLTPLCEADSTVTSDRAKRSHTDERKFLTYHEIAIIDGISPVTLFLSNSGNALSRRIYDHTAKQRLHNPCTSLTRDALAEIVTINCTSLPSDLEVPEPWVPRVPTRSRRKPDRVSRNWALGRIPPCDADPSTRTCALNPTLLISRPSQAH

SEQ ID NO: 853620 - protein, 445 aa, Homo sapiens; identical to SEQ ID NO: 853607

SEQ ID NO: 853621 - protein, 445 aa, Homo sapiens; identical to SEQ ID NO: 853607

SEQ ID NO: 853622 - protein, 445 aa, Homo sapiens; identical to SEQ ID NO: 853607

SEQ ID NO: 853623 - protein, 445 aa, Homo sapiens; identical to SEQ ID NO: 853607

SEQ ID NO: 853624 - protein, 420 aa, Homo sapiens
MNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 853625 - protein, 985 aa, Homo sapiens; identical to SEQ ID NO: 853606

SEQ ID NO: 853626 - protein, 373 aa, Homo sapiens
MALVDKHKVKRQRLDRICEGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITDIRQASWVWLQEDFLQPWKGSSLEASQ

SEQ ID NO: 853627 - protein, 445 aa, Homo sapiens; identical to SEQ ID NO: 853607

SEQ ID NO: 853628 - protein, 300 aa, Homo sapiens
MALVDKHKVKRQRLDRICEGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGSEIRASFNDMTK

SEQ ID NO: 853629 - protein, 168 aa, Homo sapiens
MTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 853630 - protein, 168 aa, Homo sapiens; identical to SEQ ID NO: 853629

SEQ ID NO: 853631 - protein, 187 aa, Homo sapiens
ASRGWPLPYFRFPAQPAPAMTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 853632 - protein, 232 aa, Homo sapiens
GSQRGRAYWSLPGVGRRWASSKAARGGVRVVGLRRAPGHSPGREAELGGRDLRAAVSPAERQELRTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 853633 - protein, 183 aa, Homo sapiens
ESARASLLEFAGGGKKTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 853634 - protein, 148 aa, Homo sapiens
RHRGAGHFRTSAFRPSQRPRWSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 853635 - protein, 168 aa, Homo sapiens; identical to SEQ ID NO: 853629

SEQ ID NO: 853636 - protein, 181 aa, Homo sapiens
MTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNVSRSSGEDPPRRLT

SEQ ID NO: 853637 - protein, 182 aa, Homo sapiens
WYRSESLDGQPAPAMTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 853638 - protein, 168 aa, Homo sapiens; identical to SEQ ID NO: 853629

SEQ ID NO: 853639 - protein, 168 aa, Homo sapiens; identical to SEQ ID NO: 853629

SEQ ID NO: 853640 - protein, 185 aa, Homo sapiens
PRVADAWVDPRVRAAPAMTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 853641 - protein, 168 aa, Homo sapiens; identical to SEQ ID NO: 853629

SEQ ID NO: 853642 - protein, 66 aa, Homo sapiens
PSLLSSSQGYDISFLITNFHTEQMYKHKLVDFVIHFMEEIDKEISEMKLSVNARARIVAEEFLKNF

SEQ ID NO: 853643 - protein, 116 aa, Homo sapiens
MTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEVRPCDP

SEQ ID NO: 853644 - protein, 982 aa, Homo sapiens [sequence omitted]

SEQ ID NO: 853645 - protein, 982 aa, Homo sapiens [sequence omitted]

SEQ ID NO: 853646 - protein, 982 aa, Homo sapiens [sequence omitted]

SEQ ID NO: 853647 - protein, 1086 aa, Homo sapiens [sequence omitted]

SEQ ID NO: 853648 - protein, 1007 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFIGTWRKSLCINVGQPLAFFYVMDSILHNRILVVVHGALYENESPNHVVASYDLWIGIARVDSRRGKSTSTTLQKAAQEHLYPLIFERIAVTVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGRKYPPPYKHFWTAES

SEQ ID NO: 853649 - protein, 1067 aa, Homo sapiens [sequence omitted]

SEQ ID NO: 853650 - protein, 1086 aa, Homo sapiens [sequence omitted]

SEQ ID NO: 853651 - protein, 518 aa, Homo sapiens
MSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGRKYPPPYKHFWTAES

SEQ ID NO: 853652 - protein, 1084 aa, Homo sapiens [sequence omitted]

SEQ ID NO: 853653 - protein, 1067 aa, Homo sapiens [sequence omitted]

SEQ ID NO: 853654 - protein, 1001 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQVGAWLWIKVEKR

SEQ ID NO: 853655 - protein, 198 aa, Homo sapiens
MEMSTELSMFFWKETQTRIPGRWSGRRRESQARRMVARRNPMRKAKKIETGTETIVGDVVGHQDGGEVPAVDESFEVRKMDWMAPRVEGLLEEEQKEAEGAVAEAEVALVGEEEGFLLKEWEPLTQLIMQSQPILMITMAIAAAIRGTTLATLNQMMGRVHGGLQQRSGGLKIGMKIFLRPRSSLPLMCLQCLCLRRM

SEQ ID NO: 853656 - protein, 298 aa, Homo sapiens
GHMLHTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGRKYPPPYKHFWTAES

SEQ ID NO: 853657 - protein, 960 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQDILNFVDDQLGE

SEQ ID NO: 853658 - protein, 875 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGAGEEASPRPV

SEQ ID NO: 853659 - protein, 851 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLIATASHFPHPLTTGHPLGSS

SEQ ID NO: 853660 - protein, 785 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSAS

SEQ ID NO: 853661 - protein, 159 aa, Homo sapiens
MLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGRKYPPPYKHFWTAES

SEQ ID NO: 853662 - protein, 392 aa, Homo sapiens
PLLPLLKHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQLPYLQMILCCQRQQEEQTGSGQRSQTSSIPQKPQTNKSAYNSYSWGAN

SEQ ID NO: 853663 - protein, 575 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASASSFIQLSTPHQQSGQLVHRY

SEQ ID NO: 853664 - protein, 146 aa, Homo sapiens
IVTVRTRIAVLSLLEITLCSKDGYNPGVSVTSSNTGVPDISGSVYSKTQQSFEKQGFHSGTPAASFNLPSALGSGGPINPATAAAYPPAPFMHILTPHQQPHSQILHHHLQQDGQTGSGQRSQTSSIPQKPQTNKSAYNSYSWGAN

SEQ ID NO: 853665 - protein, 265 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDVGIPRSFLTNAFYP

SEQ ID NO: 853666 - protein, 134 aa, Homo sapiens
FTLPLKQNRHSTSRAQATAEQIRLAQMISDHNDADFEEKVKQLIDITGKNQDECVIALHDCNGDVNRAINVLLEGNPDTHSWEMVGKKKGVSGQKDGGQTESIFLTSKLSSTTGTSPPSWWPTTSPTIVSVPVS

SEQ ID NO: 853667 - protein, 982 aa, Homo sapiens [sequence omitted]

SEQ ID NO: 853668 - protein, 982 aa, Homo sapiens [sequence omitted]

SEQ ID NO: 853669 - protein, 1103 aa, Homo sapiens [sequence omitted]

SEQ ID NO: 853670 - protein, 824 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPVSGTKGSSSKE

SEQ ID NO: 853671 - protein, 1072 aa, Homo sapiens [sequence omitted]

SEQ ID NO: 853672 - protein, 1086 aa, Homo sapiens [sequence omitted]

SEQ ID NO: 853673 - protein, 983 aa, Homo sapiens [sequence omitted]

SEQ ID NO: 853674 - protein, 367 aa, Homo sapiens
RIPPSDHEVRENLTTSRGRCYEDILRVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGRKYPPPYKHFWTAES

SEQ ID NO: 853675 - protein, 944 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFEASMHTPAVAFDFWKACSFNL

SEQ ID NO: 853676 - protein, 284 aa, Homo sapiens
VVRRCTGHHIFWAHFDIHSLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGRKYPPPYKHFWTAES

SEQ ID NO: 853677 - protein, 841 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPVSGTKGSSSKGEDVVATLFIALASDGPL

SEQ ID NO: 853678 - protein, 748 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHNTVGDVRAYLHSPSCTFPPTSVSDPGILC

SEQ ID NO: 853679 - protein, 621 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKVVAS

SEQ ID NO: 853680 - protein, 413 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYGEKMESDLNL

SEQ ID NO: 853681 - protein, 120 aa, Homo sapiens
MCTPKPQSFEKQGFHSGTPAASFNLPSALGSGGPINPATAAAYPPAPFMHILTPHQQPHSQILHHHLQQDGQLPYLQMILCCQRQQEEQTGSGQRSQTSSIPQKPQTNKSAYNSYSWGAN

SEQ ID NO: 853682 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853683 - protein, 98 aa, Homo sapiens
LFYEESLVCETPCEGPRLQLSNDNRTLTLLSVTRNDVGPYECGIQNELSVDHSDPVILNVLFQGLRPKSLSLSLCQGGCSGSSLGGPASGPQARRGFW

SEQ ID NO: 853684 - protein, 835 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLCEYICSSLAQAASPNPQGQRQDFSVPLRFKYTDPQPWTSRLSVTFCPRKTWADQVLTKNRRGGAASVLGGSGSTPYDGKTGEYLRLRLSRYKRGLAETLGLCFSLEGHCGPSIDQELPLPSDNITCGFILFAPDGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853685 - protein, 679 aa, Homo sapiens
SRGSRMSGMIAIVHVEIAPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853686 - protein, 493 aa, Homo sapiens
MYCGIHNLNDLLTTDDPVILNVRYGPDEPIHYHLSYRLISVQGMNLTLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853687 - protein, 702 aa, Homo sapiens; identical to SEQ ID NO: 853682

SEQ ID NO: 853688 - protein, 422 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSMAQTTPPFPPHTPITVQG

SEQ ID NO: 853689 - protein, 524 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853690 - protein, 451 aa, Homo sapiens
NDRCSEIHSIELIDFINVVDLESELWRLIRDRPPNHSRCLEGSGISVELMITKCKWEKATQSHFHVYPAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853691 - protein, 719 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSGKWLPGASASYSGVESIWFSPKSQEDIFFPSLCSMGTRKSQILS

SEQ ID NO: 853692 - protein, 376 aa, Homo sapiens
QSDLLLSPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853693 - protein, 639 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLMGARLIFSHQHFVNQCEICKQAKIHFLENCPNF

SEQ ID NO: 853694 - protein, 611 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPISVPPRNIREDPLNT

SEQ ID NO: 853695 - protein, 583 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSNPVEDKDAVAFTCEPEVQNTTYLWWVNGQSLPVSPRLQLSNGNMTLTLLSVKRNDAGSYECEIQNPASANRSD

SEQ ID NO: 853696 - protein, 510 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANTAQGVFQSKREEQVDPDAATNRYIQLNTAS

SEQ ID NO: 853697 - protein, 161 aa, Homo sapiens
GDLEDPPLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853698 - protein, 444 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLPSNWDYTHV

SEQ ID NO: 853699 - protein, 324 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDGPTISPSKANYRPGENLNLSCHAASNPPAQYSWFINGTFQQSTQELFIPNITVNNSGSYMCQAHNSATGLNRTTVTMITVSDWTRP

SEQ ID NO: 853700 - protein, 250 aa, Homo sapiens
SSVPPLVSAIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDGPTISPSKANYRPGENLNLSCHAASNPPAQYSWFINGTFQQSTQELFIPNITVNNSGSYMCQAHNSATGLNRTTVTMITVSDWTRP

SEQ ID NO: 853701 - protein, 225 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSNPVEDKDAVAFTCEPEVQNTTYLWWVNGQSLPVSPRLQLSNGNMTLTLLTFIGSCIVPFDAERTRGSGRVG

SEQ ID NO: 853702 - protein, 702 aa, Homo sapiens; identical to SEQ ID NO: 853682

SEQ ID NO: 853703 - protein, 702 aa, Homo sapiens; identical to SEQ ID NO: 853682

SEQ ID NO: 853704 - protein, 448 aa, Homo sapiens
RYVRSHLCSDPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853705 - protein, 386 aa, Homo sapiens
MQDAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853706 - protein, 393 aa, Homo sapiens
KLPVGPVTVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853707 - protein, 414 aa, Homo sapiens
HRGVERKTNLVDPGNLNWPQQDYIKTITVSAAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853708 - protein, 524 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853709 - protein, 623 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDDPTISPVLHLLPSRGEPQPLLPLGHAGDP

SEQ ID NO: 853710 - protein, 420 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853711 - protein, 488 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANLSTGRSSN

SEQ ID NO: 853712 - protein, 137 aa, Homo sapiens
YLEDPGWRGVSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 853713 - protein, 445 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPVLHLLPSRGEPQPLLPLGHAGDP

SEQ ID NO: 853714 - protein, 143 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYRE

SEQ ID NO: 853715 - protein, 227 aa, Homo sapiens
GLMLRRLYGSLPGCASLAEALLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSNPVEDKDAVAFTCEPEVQNTTYLWWVNGQSLPVSPRLQLSNGNMTLTLLTFIGSCIVPFDAERTRGSGRVG

SEQ ID NO: 853716 - protein, 428 aa, Homo sapiens
PPLPLPPPARTRPERRVSAQLRAARGGSGVRRCALRPLLLAPARVGPGGREPTMQLQFRSWMLAALTLLVVFLIFADISEIEEEIGNSGGRGTIRSAVNSLHSKSNRAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 853717 - protein, 371 aa, Homo sapiens
PPLPLPPPARTRPERRVSAQLRAARGGSGVRRCALRPLLLAPARVGPGGREPTMQLQFRSWMLAALTLLVVFLIFADISEIEEEIGNSGGRGTIRSAVNSLHSKSNRAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGIPDH

SEQ ID NO: 853718 - protein, 407 aa, Homo sapiens
PPLPLPPPARTRPERRVSAQLRAARGGSGVRRCALRPLLLAPARVGPGGREPTMQLQFRSWMLAALTLLVVFLIFADISEIEEEIGAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 853719 - protein, 202 aa, Homo sapiens
MNPEYDYLFKLLLIGDSGVGKSCLLLRFADDTYTESYISTIGVDFKIRTIELDGKTIKLQIWDTAGQERFRTITSSYYRGAHGIIVVYDVTDQESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 853720 - protein, 202 aa, Homo sapiens; identical to SEQ ID NO: 853719

SEQ ID NO: 853721 - protein, 202 aa, Homo sapiens; identical to SEQ ID NO: 853719

SEQ ID NO: 853722 - protein, 184 aa, Homo sapiens
MNPEYDYLFKLLLIGDSGVGKSCLLLRFADDTYTESYISTIGVDFKIRTIELDGITSSYYRGAHGIIVVYDVTDQESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 853723 - protein, 150 aa, Homo sapiens
MNPEYDYLFKLLLIGDSGVGKSCLLLRFADDTYTESYISTIGVDFKIRTIELDGKTIKLQIVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 853724 - protein, 153 aa, Homo sapiens
MNPEYDYLFKLLLIGDSGVGKSCLLLRFADDTYTESYISTIGVDFKIRTIELDGKTIKLQIWDTAGQERFRTITSSYYRGAHGIIVVYDVTDQVSSKRRLCYSDQVGSHYLINVRFIYYFIYKPSVLILWQKTLSTLKYKCESLKRHLFSCNK

SEQ ID NO: 853725 - protein, 51 aa, Homo sapiens
MYDFEPHFPPLIAPAPQKVRIKYTHVCKAHGKSLTNNRNSNNKHRTHPRER

SEQ ID NO: 853726 - protein, 81 aa, Homo sapiens
KLLQHKLLQHKLLQHKLLQHKLLQHKLLQHKLFPLPPTLFPNFILMELFGFLDCFVIVGTQQARKDFEQSPPVITEEPMAS

SEQ ID NO: 853727 - protein, 202 aa, Homo sapiens; identical to SEQ ID NO: 853719

SEQ ID NO: 853728 - protein, 202 aa, Homo sapiens; identical to SEQ ID NO: 853719

SEQ ID NO: 853729 - protein, 202 aa, Homo sapiens; identical to SEQ ID NO: 853719

SEQ ID NO: 853730 - protein, 174 aa, Homo sapiens
MNPEYDYLFKLLLIGDSGVGKSCLLLRFADDTYTESYISTIGVDFKIRTIELDGKTIKLQIWDTAGQERFRTITSSYYRGAHGIIVVYDVTDQESFNNVKQWLQEIDRYASENVNKLLVGNKCDLTTKKVVDYTTAKVCLKFNFHTEFEGVELCMGSAVTVRPQPFKNMCTRIL

SEQ ID NO: 853731 - protein, 138 aa, Homo sapiens
MNPEYDYLFKLLLIGDSGVGKSCLLLRFAESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 853732 - protein, 126 aa, Homo sapiens
MNPEYDYLFKLLLIGDSGVGKSCLLLRFADDTYTESYISTIGVDFKIRTIELDGKTIKLQIEFADSLGIPFLETSAKNATNVEQSFMTMAAEIKKRMGPGATAGGAEKSNVKIQSTPVKQSGGGCC

SEQ ID NO: 853733 - protein, 174 aa, Homo sapiens; identical to SEQ ID NO: 853730

SEQ ID NO: 853734 - protein, 870 aa, Homo sapiens
MKGWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 853735 - protein, 870 aa, Homo sapiens; identical to SEQ ID NO: 853734

SEQ ID NO: 853736 - protein, 682 aa, Homo sapiens
MTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 853737 - protein, 682 aa, Homo sapiens; identical to SEQ ID NO: 853736

SEQ ID NO: 853738 - protein, 479 aa, Homo sapiens [sequence omitted]

SEQ ID NO: 853739 - protein, 747 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKEVLNYLSVLFLLELTETFNI

SEQ ID NO: 853740 - protein, 375 aa, Homo sapiens [sequence omitted]

SEQ ID NO: 853741 - protein, 1047 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 853742 - protein, 1047 aa, Homo sapiens; identical to SEQ ID NO: 853741

SEQ ID NO: 853743 - protein, 978 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGVCI

SEQ ID NO: 853744 - protein, 999 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGLFYFAATMWGVKQDDDTVLTRLNK

SEQ ID NO: 853745 - protein, 1005 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPGTTGAIERGPWSPVFQGNWPMEEC

SEQ ID NO: 853746 - protein, 787 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEGMVWPC

SEQ ID NO: 853747 - protein, 747 aa, Homo sapiens; identical to SEQ ID NO: 853739

SEQ ID NO: 853748 - protein, 350 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKM

SEQ ID NO: 853749 - protein, 270 aa, Homo sapiens
MKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATNLIHETNNTRQAPWMEAEILKGHGNTRAVRHAVKDSIEKIMAKPGQGEKSHQR

SEQ ID NO: 853750 - protein, 1047 aa, Homo sapiens; identical to SEQ ID NO: 853741

SEQ ID NO: 853751 - protein, 870 aa, Homo sapiens; identical to SEQ ID NO: 853734

SEQ ID NO: 853752 - protein, 166 aa, Homo sapiens
MKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELSQRTQ

SEQ ID NO: 853753 - protein, 870 aa, Homo sapiens; identical to SEQ ID NO: 853734

SEQ ID NO: 853754 - protein, 637 aa, Homo sapiens
MGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 853755 - protein, 479 aa, Homo sapiens [sequence omitted]

SEQ ID NO: 853756 - protein, 479 aa, Homo sapiens [sequence omitted]

SEQ ID NO: 853757 - protein, 479 aa, Homo sapiens [sequence omitted]

SEQ ID NO: 853758 - protein, 911 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVRFSISYCCKNTDISG

SEQ ID NO: 853759 - protein, 375 aa, Homo sapiens [sequence omitted]

SEQ ID NO: 853760 - protein, 552 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEH

SEQ ID NO: 853761 - protein, 94 aa, Homo sapiens
VETVCAVIPKLIEHRYDGIGVNSNASQNASQQSVMIMLGDDLGNVTLTCSAPYIGYDKGPGPARVVSAVAMSIPCALMSDAHYRTSATVNCSVC

SEQ ID NO: 853762 - protein, 868 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPP

SEQ ID NO: 853763 - protein, 308 aa, Homo sapiens [sequence omitted]

SEQ ID NO: 853764 - protein, 263 aa, Homo sapiens
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 853765 - protein, 263 aa, Homo sapiens; identical to SEQ ID NO: 853764

SEQ ID NO: 853766 - protein, 123 aa, Homo sapiens
LCPACKRTPSRITIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 853767 - protein, 67 aa, Homo sapiens
RGRATGCEKTYEGVKDANGNSARGSNMSLAMAINLGFPCPGERAFDLLLLKREIRGWPPNRAVAKLQ

SEQ ID NO: 853768 - protein, 263 aa, Homo sapiens; identical to SEQ ID NO: 853764

SEQ ID NO: 853769 - protein, 263 aa, Homo sapiens; identical to SEQ ID NO: 853764

SEQ ID NO: 853770 - protein, 263 aa, Homo sapiens; identical to SEQ ID NO: 853764

SEQ ID NO: 853771 - protein, 263 aa, Homo sapiens; identical to SEQ ID NO: 853764

SEQ ID NO: 853772 - protein, 263 aa, Homo sapiens; identical to SEQ ID NO: 853764

SEQ ID NO: 853773 - protein, 272 aa, Homo sapiens
MLGRPAKFSKARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 853774 - protein, 290 aa, Homo sapiens
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSGSGDVLHYPPHYAQITMTSAVWFNPGPI

SEQ ID NO: 853775 - protein, 181 aa, Homo sapiens
MYATFHVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 853776 - protein, 211 aa, Homo sapiens
PCLAFLCFLMHARGQRDFDLADALDDPEPTKKPNSDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 853777 - protein, 150 aa, Homo sapiens
MHEDSNSYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 853778 - protein, 216 aa, Homo sapiens
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGCKNKNKPNKPASKQEEENNNNTNLEIDLSDVNISFLGK

SEQ ID NO: 853779 - protein, 39 aa, Homo sapiens
YTLLWSDVISIEKTGEHFRLVYDTKGRFAVHRITVEEAK

SEQ ID NO: 853780 - protein, 111 aa, Homo sapiens
MVTEQEEVSMGKPDPWRGSGSDNQEEEPLERDFDRFLGTTTSFSRFTLWAWGFTLWGTLWGFLGPEAKLRGALTWPSLAATIHAQVPKDTEPELEIQSREPFTAVNQLLTL

SEQ ID NO: 853781 - protein, 36 aa, Homo sapiens
MHARGQRDFDLADALDDPEPTKKPNSDIYPKPKPPY

SEQ ID NO: 853782 - protein, 263 aa, Homo sapiens; identical to SEQ ID NO: 853764

SEQ ID NO: 853783 - protein, 263 aa, Homo sapiens; identical to SEQ ID NO: 853764

SEQ ID NO: 853784 - protein, 263 aa, Homo sapiens; identical to SEQ ID NO: 853764

SEQ ID NO: 853785 - protein, 263 aa, Homo sapiens; identical to SEQ ID NO: 853764

SEQ ID NO: 853786 - protein, 263 aa, Homo sapiens; identical to SEQ ID NO: 853764

SEQ ID NO: 853787 - protein, 263 aa, Homo sapiens; identical to SEQ ID NO: 853764

SEQ ID NO: 853788 - protein, 198 aa, Homo sapiens [sequence omitted]

SEQ ID NO: 853789 - protein, 231 aa, Homo sapiens
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNC

SEQ ID NO: 853790 - protein, 182 aa, Homo sapiens
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINLDILVLLMWCM

SEQ ID NO: 853791 - protein, 182 aa, Homo sapiens; identical to SEQ ID NO: 853790

SEQ ID NO: 853792 - protein, 75 aa, Homo sapiens
EPARHEEGTGSHASTHSAVQPFSLNSPQPFHPFIPSQRFENLFRRGKQACPDEQTLTDTWMHKHPGDARSHKPTQ

SEQ ID NO: 853793 - protein, 130 aa, Homo sapiens
GRVRSGASSLESGMSVSSCPCPLLNGNPHQLPREPVSLHSIRICSSSVTSAMDSFRSSTNFCISSEPRAQKCSTCFFSLNSPQPFHPFIPSQRFENLFRRGKQACPDEQTLTDTWMHKHPGDARSHKPTQ

SEQ ID NO: 853794 - protein, 580 aa, Homo sapiens
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVSQEILELLNTTTAKEQSIVEKFRSRGRAQVQEFCDYGTKEECMKASDADRPCRKLHFRRIINKHTDESLGDCSFLNTCFHMDTCKYVHYEIDACMDSEAPGSKDHTPSQELALTQSVGGDSSADRLFPPQWICCDIRYLDVSILGKFAVVMADPPWDIHMELPYGTLTDDEMRRLNIPVLQDDGFLFLWVTGRAMELGRECLNLWGYERVDEIIWVKTNQLQRIIRTGRTGHWLNHGKEHCLVGVKGNPQGFNQGLDCDVIVAEVRSTSHKPDEIYGMIERLSPGTRKIELFGRPHNVQPNWITLGNQLDGIHLLDPDVVARFKQRYPDGIISKPKNL

SEQ ID NO: 853795 - protein, 580 aa, Homo sapiens; identical to SEQ ID NO: 853794

SEQ ID NO: 853796 - protein, 305 aa, Homo sapiens
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVSQEILELLNTTTAKEQSIVEKFRSRGRAQVQEFCDYGTKEECMKASDADRPCRKLHFRSLGRE

SEQ ID NO: 853797 - protein, 505 aa, Homo sapiens
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVSQEILELLNTTTAKEQSIVEKFRSRGRAQVQEFCDYGTKEECMKASDADRPCRKLHFRRIINKHTDESLGDCSFLNTCFHMDTCKYVHYEIDACMDSEAPGSKDHTPSQELALTQSVGGDSSADRLFPPQWICCDIRYLDVSILGKFAVVMADPPWDIHMELPYGTLTDDEMRRLNIPVLQDDGFLFLWVTGRAMELGRECLNLWGYERVDEIIWVKTNQLQRIIRTGRTGHWLNHGKEHCLVSSSGAQFNRWSTKKNHLISY

SEQ ID NO: 853798 - protein, 505 aa, Homo sapiens; identical to SEQ ID NO: 853797

SEQ ID NO: 853799 - protein, 448 aa, Homo sapiens
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVSQEILELLNTTTAKEQSIVEKFRSRGRAQVQEFCDYGTKEECMKASDADRPCRKLHFRRIINKHTDESLGDCSFLNTCFHMDTCKYVHYEIDACMDSEAPGSKDHTPSQELALTQSVGGDSSADRLFPPQWICCDIRYLDVSILGKFAVVMADPPWDIHMELPYGTLTDDEMRRLNIPVLQDDGFLFLWVTGRAMELGRECLNLWG

SEQ ID NO: 853800 - protein, 505 aa, Homo sapiens; identical to SEQ ID NO: 853797

SEQ ID NO: 853801 - protein, 435 aa, Homo sapiens [sequence omitted]

SEQ ID NO: 853802 - protein, 425 aa, Homo sapiens
MMGAVAEKKGPGEVAGTVTGQKRRAEQDSTTVAAFASSLVSGLNSSASEPAKEPAKKSRKHAASDVDLEIESLLNQQSTKEQQSKKVSQEILELLNTTTAKEQSIVEKFRSRGRAQVQEFCDYGTKEECMKASDADRPCRKLHFRRIINKHTDESLGDCSFLNTCFHMDTCKYVHYEIDACMDSEAPGSKDHTPSQELALTQSVGGDSSADRLFPPQWICCDIRYLDVSILGKFAVVMADPPWDIHMELPYGTLTDDEMRRLNIPVLQDDGFLFLWVTGRAMELGRECLNLWGYERVDEIIWVKTNQLQRIIRTGRTGHWLNHGKEHCLVGVKGNPQGFNQGLDCDVIVAEVRSTSHKPDEIYGMIERLSPGTRKIELFGRPHNVQPNWITLGNQLDGIHLLDPDVVARFKQRYPDGIISKPKNL

SEQ ID NO: 853803 - protein, 245 aa, Homo sapiens [sequence omitted]

SEQ ID NO: 853804 - protein, 296 aa, Homo sapiens
MKASDADRPCRKLHFRRIINKHTDESLGDCSFLNTCFHMDTCKYVHYEIDACMDSEAPGSKDHTPSQELALTQSVGGDSSADRLFPPQWICCDIRYLDVSILGKFAVVMADPPWDIHMELPYGTLTDDEMRRLNIPVLQDDGFLFLWVTGRAMELGRECLNLWGYERVDEIIWVKTNQLQRIIRTGRTGHWLNHGKEHCLVGVKGNPQGFNQGLDCDVIVAEVRSTSHKPDEIYGMIERLSPGTRKIELFGRPHNVQPNWITLGNQLDGIHLLDPDVVARFKQRYPDGIISKPKNL

SEQ ID NO: 853805 - protein, 258 aa, Homo sapiens
MDTCKYVHYEIDACMDSEAPGSKDHTPSQELALTQSVGGDSSADRLFPPQWICCDIRYLDVSILGKFAVVMADPPWDIHMELPYGTLTDDEMRRLNIPVLQDDGFLFLWVTGRAMELGRECLNLWGYERVDEIIWVKTNQLQRIIRTGRTGHWLNHGKEHCLVGVKGNPQGFNQGLDCDVIVAEVRSTSHKPDEIYGMIERLSPGTRKIELFGRPHNVQPNWITLGNQLDGIHLLDPDVVARFKQRYPDGIISKPKNL

SEQ ID NO: 853806 - protein, 580 aa, Homo sapiens; identical to SEQ ID NO: 853794

SEQ ID NO: 853807 - protein, 505 aa, Homo sapiens; identical to SEQ ID NO: 853797

SEQ ID NO: 853808 - protein, 305 aa, Homo sapiens; identical to SEQ ID NO: 853796

SEQ ID NO: 853809 - protein, 258 aa, Homo sapiens
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVGPKCKNSVTMEPRRSA

SEQ ID NO: 853810 - protein, 609 aa, Homo sapiens
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTVNDLTELGFTTYFQFTVSVLLPIPPLVLKPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVSQEILELLNTTTAKEQSIVEKFRSRGRAQVQEFCDYGTKEECMKASDADRPCRKLHFRRIINKHTDESLGDCSFLNTCFHMDTCKYVHYEIDACMDSEAPGSKDHTPSQELALTQSVGGDSSADRLFPPQWICCDIRYLDVSILGKFAVVMADPPWDIHMELPYGTLTDDEMRRLNIPVLQDDGFLFLWVTGRAMELGRECLNLWGYERVDEIIWVKTNQLQRIIRTGRTGHWLNHGKEHCLVGVKGNPQGFNQGLDCDVIVAEVRSTSHKPDEIYGMIERLSPGTRKIELFGRPHNVQPNWITLGNQLDGIHLLDPDVVARFKQRYPDGIISKPKNL

SEQ ID NO: 853811 - protein, 296 aa, Homo sapiens; identical to SEQ ID NO: 853804

SEQ ID NO: 853812 - protein, 103 aa, Homo sapiens
MSDTWSSIQAHKKQLDSLRERLQRRRKQDSGHLAADVRPSASSSRFLLTLGLGSSSSLLPDGRLSPTLVRLAHSSSDCEDVAFVRLLSPLSREAARTPFCCCF

SEQ ID NO: 853813 - protein, 558 aa, Homo sapiens
MAKNRRDRNSWGGFSEKTYEWSSEEEEPVKKAGPVQVLIVKDDHSFELDETALNRILLSEAVRDKEVVAVSVAGAFRKGKSFLMDFMLRYMYNQESVDWVGDYNEPLTGFSWRGGSERETTGIQIWSEIFLINKPDGKKVAVLLMDTQGTFDSQSTLRDSATVFALSTMISSIQVYNLSQNVQEDDLQHLQLFTEYGRLAMEETFLKPFQSLIFLVRDWSFPYEFSYGADGGAKFLEKRLKVSGNQHEELQNVRKHIHSCFTNISCFLLPHPGLKVATNPNFDGKLKEIDDEFIKNLKILIPWLLSPESLDIKEINGNKITCRGLVEYFKAYIKIYQGEELPHPKSMLQATAEANNLAAVATAKDTYNKKMEEICGGDKPFLAPNDLQTKHLQLKEESVKLFRGVKKMGGEEFSRRYLQQLESEIDELYIQYIKHNDSKNIFHAARTPATLFVVIFITYVIAGVTGFIGLDIIASLCNMIMGLTLITLCTWAYIRYSGEYRELGAVIDQVAAALWDQGSTNEALYKLYSAAATHRHLYHQAFPTPKSESTEQSEKKKM

SEQ ID NO: 853814 - protein, 558 aa, Homo sapiens; identical to SEQ ID NO: 853813

SEQ ID NO: 853815 - protein, 286 aa, Homo sapiens
SSSLRSSINFDGKLKEIDDEFIKNLKILIPWLLSPESLDIKEINGNKITCRGLVEYFKAYIKIYQGEELPHPKSMLQATAEANNLAAVATAKDTYNKKMEEICGGDKPFLAPNDLQTKHLQLKEESVKLFRGVKKMGGEEFSRRYLQQLESEIDELYIQYIKHNDSKNIFHAARTPATLFVVIFITYVIAGVTGFIGLDIIASLCNMIMGLTLITLCTWAYIRYSGEYRELGAVIDQVAAALWDQGSTNEALYKLYSAAATHRHLYHQAFPTPKSESTEQSEKKKM

SEQ ID NO: 853816 - protein, 558 aa, Homo sapiens; identical to SEQ ID NO: 853813

SEQ ID NO: 853817 - protein, 295 aa, Homo sapiens [sequence omitted]

SEQ ID NO: 853818 - protein, 175 aa, Homo sapiens
MAKNRRDRNSWGGFSEKTYEWSSEEEEPVKKAGPVQVLIVKDDHSFELDETALNRILLSEAVRDKEVVAVSVAGAFRKGKSFLMDFMLRYMYNQESVDWVGDYNEPLTGFSWRGGSERETTGIQIWSEIFLINKPDGKKVAVLLMDTQGTFDSQSTLRDSATVFALSTMISSIQV

SEQ ID NO: 853819 - protein, 1167 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 853820 - protein, 1167 aa, Homo sapiens; identical to SEQ ID NO: 853819

SEQ ID NO: 853821 - protein, 1135 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGQSIFFIKLHT

SEQ ID NO: 853822 - protein, 1037 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALPSN

SEQ ID NO: 853823 - protein, 855 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKSLWVKHQGSQQGQSSRRGSAETNLTRIDRST

SEQ ID NO: 853824 - protein, 382 aa, Homo sapiens
LTNKVSGTVDTINEVWMHECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 853825 - protein, 287 aa, Homo sapiens
KHKNEQNLETNLHLEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 853826 - protein, 1167 aa, Homo sapiens; identical to SEQ ID NO: 853819

SEQ ID NO: 853827 - protein, 1167 aa, Homo sapiens; identical to SEQ ID NO: 853819

SEQ ID NO: 853828 - protein, 1129 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 853829 - protein, 805 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLMVTQRITHNIMLRFTRSAP

SEQ ID NO: 853830 - protein, 341 aa, Homo sapiens
MGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 853831 - protein, 339 aa, Homo sapiens
TNTVEKIMQPKKESSMTHAVTWMNLENIYAERSQTQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 853832 - protein, 201 aa, Homo sapiens
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 853833 - protein, 201 aa, Homo sapiens; identical to SEQ ID NO: 853832

SEQ ID NO: 853834 - protein, 201 aa, Homo sapiens; identical to SEQ ID NO: 853832

SEQ ID NO: 853835 - protein, 201 aa, Homo sapiens; identical to SEQ ID NO: 853832

SEQ ID NO: 853836 - protein, 151 aa, Homo sapiens
MRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 853837 - protein, 209 aa, Homo sapiens
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKGECGAIWCRAGEAYW

SEQ ID NO: 853838 - protein, 313 aa, Homo sapiens
SAGPRWRGVGARGVWGLEACGVGAFGGAGSAEAWGLQGPRVTLGWVGERPSPRGTAPASRNWCGRRVSSGSAHLGLPTSTVHLFFPSPTQHFIHSVLTSGTATGLCGRSSRSSVGQQDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 853839 - protein, 155 aa, Homo sapiens
MVEGERAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 853840 - protein, 163 aa, Homo sapiens
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKGGC

SEQ ID NO: 853841 - protein, 344 aa, Homo sapiens
SAGPRWRGVGARGVWGLEACGVGAFGGAGSAEAWGLQGPRVTLGWVGERPSPRGTAQPPGTGAGGGFPPARPTWGSPLDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKGDVVPWVGGLLCRLTLHLTILPGGCFFCLPDKHSRVLWPPHVSRVMQLPGDTGASWGALSTCQCCWPQSNWAGIGVRALPGAHQKVLYDGPRFVSQRAWSPLP

SEQ ID NO: 853842 - protein, 240 aa, Homo sapiens
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYNVPLNSEQARSELRAHGGVESARRALMGGRSAQAGLGTRITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 853843 - protein, 67 aa, Homo sapiens
MPLLPCSQLHEGHPILLLCPLAWRPHCPFLPLASEDPGSPLVEQGVLSFCSIDFFGIVKLINPPPGV

SEQ ID NO: 853844 - protein, 118 aa, Homo sapiens
SAGPRWRGVGARGVWGLEACGVGAFGGAGSAEAWGLQGPRVTLGWVGERPSPRGTAPASRNWCGRRVSSGSAHLGLPTSTVHLFFPSPTQHFIHSVLTSGTATGLCGRSSRSSVGHRS

SEQ ID NO: 853845 - protein, 278 aa, Homo sapiens
MGSALGRARRTLSGRPFQRAPCKTRRALSLSAALRNVTKAQGGCPKSLVLWGCRPKRPRKRRTSLKLAWRGTFCSSSLKISEDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 853846 - protein, 201 aa, Homo sapiens; identical to SEQ ID NO: 853832

SEQ ID NO: 853847 - protein, 201 aa, Homo sapiens; identical to SEQ ID NO: 853832

SEQ ID NO: 853848 - protein, 313 aa, Homo sapiens; identical to SEQ ID NO: 853838

SEQ ID NO: 853849 - protein, 271 aa, Homo sapiens
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKGDVVPWVGGLLCRLTLHLTILPGGCFFCLPDKHSRVLWPPHVSRVMQLPGDTGASWGALSTCQCCWPQSNWAGIGVRALPGAHQKVLYDGPRFVSQRAWSPLP

SEQ ID NO: 853850 - protein, 271 aa, Homo sapiens; identical to SEQ ID NO: 853849

SEQ ID NO: 853851 - protein, 112 aa, Homo sapiens
MRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 853852 - protein, 240 aa, Homo sapiens; identical to SEQ ID NO: 853842

SEQ ID NO: 853853 - protein, 240 aa, Homo sapiens; identical to SEQ ID NO: 853842

SEQ ID NO: 853854 - protein, 42 aa, Homo sapiens
MGMDDKSKVDTLREEESAGGEPWDVSAFAAHATTDEPVRDKG

SEQ ID NO: 853855 - protein, 179 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGETPPSLFPLIHLPLPRSVPLFLSTLE

SEQ ID NO: 853856 - protein, 279 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVSKNAKARTRKCSLVSGHGRENKSCRGWGWGQGF

SEQ ID NO: 853857 - protein, 279 aa, Homo sapiens; identical to SEQ ID NO: 853856

SEQ ID NO: 853858 - protein, 316 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVDPTTHLTFNLHLSKKEREARDSLILPFQFSSEKQQALLRPRPGQATSHIFYEPDAYDDLDQEDPDDDLDI

SEQ ID NO: 853859 - protein, 279 aa, Homo sapiens; identical to SEQ ID NO: 853856

SEQ ID NO: 853860 - protein, 252 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPTAGSPAA

SEQ ID NO: 853861 - protein, 319 aa, Homo sapiens
RKGQGSQARCGNRDGFAKAVIPALSYPLSVPRSADSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVDPTTHLTFNLHLSKKEREARDSLILPFQFSSEKQQALLRPRPGQATSHIFYEPDAYDDLDQEDPDDDLDI

SEQ ID NO: 853862 - protein, 291 aa, Homo sapiens
NYRLGSDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVDPTTHLTFNLHLSKKEREARDSLILPFQFSSEKQQALLRPRPGQATSHIFYEPDAYDDLDQEDPDDDLDI

SEQ ID NO: 853863 - protein, 257 aa, Homo sapiens
MLSAKMLLSELFPILALSSSLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVDPTTHLTFNLHLSKKEREARDSLILPFQFSSEKQQALLRPRPGQATSHIFYEPDAYDDLDQEDPDDDLDI

SEQ ID NO: 853864 - protein, 279 aa, Homo sapiens
LGCDLVTGRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTRDSSSVGKVSVLGLLHEELHGPGPVGALSSLAQTEVTLGGTMGQASAHILCRRPRQRPTDQTQWFSILPDFSLDLQEGPSVESQPYSDPHIPPVDPTTHLTFNLHLSKKEREARDSLILPFQFSSEKQQALLRPRPGQATSHIFYEPDAYDDLDQEDPDDDLDI

SEQ ID NO: 853865 - protein, 264 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTRDSSSVGKVSVLGLLHEELHGPGPVGALSSLAQTEVTLGGTMGQASAHILCRRPRQRPTDQTQWFSILPDFSLDLQEGPSVESQPYSDPHIPPVSKNAKARTRKCSLVSGHGRENKSCRGWGWGQGF

SEQ ID NO: 853866 - protein, 146 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTRKREKPEIA

SEQ ID NO: 853867 - protein, 316 aa, Homo sapiens; identical to SEQ ID NO: 853858

SEQ ID NO: 853868 - protein, 316 aa, Homo sapiens; identical to SEQ ID NO: 853858

SEQ ID NO: 853869 - protein, 279 aa, Homo sapiens; identical to SEQ ID NO: 853856

SEQ ID NO: 853870 - protein, 294 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVDPTTHLTFNLHLSKKEREARDSLILPFQFSSEKGGLWASRADAFLAVE

SEQ ID NO: 853871 - protein, 316 aa, Homo sapiens; identical to SEQ ID NO: 853858

SEQ ID NO: 853872 - protein, 299 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVDPTTHLTFNLHLSNIFLLFVLALPCPCPTLVPLVYGAPPCEPGSSVSSGQKVG

SEQ ID NO: 853873 - protein, 267 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHITQWFSILPDFSLDLQEGPSVESQPYSDPHIPPVSKNAKARTRKCSLVSGHGRENKSCRGWGWGQGF

SEQ ID NO: 853874 - protein, 123 aa, Homo sapiens
MGQASAHILCRRPRQRPTDQTQWFSILPDFSLDLQEGPSVESQPYSDPHIPPVDPTTHLTFNLHLSKKEREARDSLILPFQFSSEKQQALLRPRPGQATSHIFYEPDAYDDLDQEDPDDDLDI

SEQ ID NO: 853875 - protein, 179 aa, Homo sapiens; identical to SEQ ID NO: 853855

SEQ ID NO: 853876 - protein, 172 aa, Homo sapiens
MTSSETLSTGRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPTAGFLRLCRAATSTSFMSNAMMTGPKRPN

SEQ ID NO: 853877 - protein, 1000 aa, Homo sapiens
PASQPSPRRLGSLALPGVLSARSPLASPRCSVPCPARPGADTTAIMPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 853878 - protein, 91 aa, Homo sapiens
GGCFTDLSERAWDLDEVVIVEVRAKRRKLRESTRNWPTSAPSSKRDKSLWMRYEKKQIVCVNWLFILPCLAYDYGLVGTVEGCEFVSSFQL

SEQ ID NO: 853879 - protein, 1022 aa, Homo sapiens
PASQPSPRRLGSLALPGVLSARSPLASPRCSVPCPARPGADTTAIMPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSELEPPAPESPMALLADPAPAADPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 853880 - protein, 574 aa, Homo sapiens
PASQPSPRRLGSLALPGVLSARSPLASPRCSVPCPARPGADTTAIMPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSN

SEQ ID NO: 853881 - protein, 633 aa, Homo sapiens
PASQPSPRRLGSLALPGVLSARSPLASPRCSVPCPARPGADTTAIMPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSRRPRPPPTSWGCGQPLPRQHPRLLQEQGTFWWTSSMARPPSPAWGPPPRRPSSAQVLRTSALPFRKPMSC

SEQ ID NO: 853882 - protein, 771 aa, Homo sapiens
PISRLPTLANAVQGQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 853883 - protein, 619 aa, Homo sapiens
PASQPSPRRLGSLALPGVLSARSPLASPRCSVPCPARPGADTTAIMPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLSPLPPHPVVAPPTPSPSRGCVLL

SEQ ID NO: 853884 - protein, 570 aa, Homo sapiens
PASQPSPRRLGSLALPGVLSARSPLASPRCSVPCPARPGADTTAIMPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSRLRLPQPA

SEQ ID NO: 853885 - protein, 106 aa, Homo sapiens
AVQVPDLTFPVPSPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 853886 - protein, 88 aa, Homo sapiens
LPMRGHGPGFYSHWRPLLDGCEVPRGSVRGLDMWFWGSVLRACSRTQSLWAFAPPHQVPSHLTLLHASSPGPEDIGPPIPEADELLNK

SEQ ID NO: 853887 - protein, 980 aa, Homo sapiens
PASQPSPRRLGSLALPGVLSARSPLASPRCSVPCPARPGADTTAIMPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNLVTEKTPGFGGCLGLSSGLLYFYFCSSAAVYILGG

SEQ ID NO: 853888 - protein, 1000 aa, Homo sapiens; identical to SEQ ID NO: 853877

SEQ ID NO: 853889 - protein, 955 aa, Homo sapiens
PASQPSPRRLGSLALPGVLSARSPLASPRCSVPCPARPGADTTAIMPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLFWGLALLSWTMWTPTLRTSWGRGSSRLKPCRWAVCFGWSPMPRPRCTG

SEQ ID NO: 853890 - protein, 795 aa, Homo sapiens
MDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 853891 - protein, 619 aa, Homo sapiens; identical to SEQ ID NO: 853883

SEQ ID NO: 853892 - protein, 280 aa, Homo sapiens
CSGIGWLSELEPPAPESPMALLADPAPAADPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 853893 - protein, 221 aa, Homo sapiens
PASQPSPRRLGSLALPGVLSARSPLASPRCSVPCPARPGADTTAIMPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEALYSQKEAQAALCLTLSKLPPATRCGDVSGK

SEQ ID NO: 853894 - protein, 62 aa, Homo sapiens
MWAGHSAGGVPFVSPEDAAVKGRLVECLETVLNKAQEPPKSKKVQHSNAKNAILFETISLII

SEQ ID NO: 853895 - protein, 310 aa, Homo sapiens
AGSSLGRCAEARRLYNSAVVTMPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAPIRRNKEEPKARPLRVGDTEKPEPERSPPNRKRPANEKATDDYHYEKFKKMNRRY

SEQ ID NO: 853896 - protein, 289 aa, Homo sapiens
MPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAPIRRNKEEPKARPLRVGDTEKPEPERSPPNRKRPANEKATDDYHYEKFKKMNRRY

SEQ ID NO: 853897 - protein, 310 aa, Homo sapiens; identical to SEQ ID NO: 853895

SEQ ID NO: 853898 - protein, 310 aa, Homo sapiens; identical to SEQ ID NO: 853895

SEQ ID NO: 853899 - protein, 309 aa, Homo sapiens
HSGQSAVAHHSLIENNRKPNYLMHCLLQFYWVSILPSYKPHSTSSPPPGTCKIGTPGYIARHVPGGLSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAPIRRNKEEPKARPLRVGDTEKPEPERSPPNRKRPANEKATDDYHYEKFKKMNRRY

SEQ ID NO: 853900 - protein, 211 aa, Homo sapiens
MKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAPIRRNKEEPKARPLRVGDTEKPEPERSPPNRKRPANEKATDDYHYEKFKKMNRRY

SEQ ID NO: 853901 - protein, 126 aa, Homo sapiens
MLSNQMLSGIPEVDLGIDAKIKNIISTEDAKARLLAEQQNKKKDSETSFVPTNMAVNYVQHNRFYHEELNAPIRRNKEEPKARPLRVGDTEKPEPERSPPNRKRPANEKATDDYHYEKFKKMNRRY

SEQ ID NO: 853902 - protein, 274 aa, Homo sapiens
AGSSLGRCAEARRLYNSAVVTMPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNARHTDYRREPSSLAREIVSR

SEQ ID NO: 853903 - protein, 72 aa, Homo sapiens
SLGKALGLLCGKETGSCLCLHGVKSSSGFQHGKPPFLFFSFSGSPPNRKRPANEKATDDYHYEKFKKMNRRY

SEQ ID NO: 853904 - protein, 187 aa, Homo sapiens
AGSSLGRCAEARRLYNSAVVTMPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKPQKGYRA

SEQ ID NO: 853905 - protein, 253 aa, Homo sapiens
MPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNARHTDYRREPSSLAREIVSR

SEQ ID NO: 853906 - protein, 310 aa, Homo sapiens; identical to SEQ ID NO: 853895

SEQ ID NO: 853907 - protein, 310 aa, Homo sapiens; identical to SEQ ID NO: 853895

SEQ ID NO: 853908 - protein, 268 aa, Homo sapiens
ARQGSEPEERKVSARDARRHADAFNASAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAPIRRNKEEPKARPLRVGDTEKPEPERSPPNRKRPANEKATDDYHYEKFKKMNRRY

SEQ ID NO: 853909 - protein, 362 aa, Homo sapiens
AGSSLGRCAEARRLYNSAVVTMPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAPIRRNKEEPKARPLRVGDTEKPEPERSPPKPASVLAKRERQAVMTVVNVVKKSFIDTTESRDEYLKICCHDGGECKSIRPVRVLARIVPPAPVREIGFLAGRGGSCL

SEQ ID NO: 853910 - protein, 273 aa, Homo sapiens
AGSSLGRCAEARRLYNSAVVTMPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAPIRRNKEEPKARPLRVPS

SEQ ID NO: 853911 - protein, 81 aa, Homo sapiens
EIKSKKDKAIETKLNELIKDNDDLMKGSQYSMQMPKARPLRVGDTEKPEPERSPPNRKRPANEKATDDYHYEKFKKMNRRY

SEQ ID NO: 853912 - protein, 536 aa, Homo sapiens
MNTADQARVGPADDGPAPSGEEEGEGGGEAGGKEPAADAAPGPSAAFRLMVTRREPAVKLQYAVSGLEPLAWSEDHRVSVSTARSIAVLELICDVHNPGQDLVIHRTSVPAPLNSCLLKVGSKTEVAECKEKFAASKDPTVSQTFMLDRVFNPEGKALPPMRGFKYTSWSPMGCDANGRCLLAALTMDNRLTIQANLNRLQWVQLVDLTEIYGERLYETSYRLSKNEAPEGNLGDFAEFQRRHSMQTPVRMEWSGICTTQQVKHNNECRDVGSVLLAVLFENGNIAVWQFQLPFVGKESISSCNTIESGITSPSVLFWWEYEHNNRKMSGLIVGSAFGPIKILPVNLKAVKGYFTLRQPVILWKEMDQLPVHSIKCVPLYHPYQKCSCSLVVAARGSYVFWCLLLISKAGLNVHNSHVTGLHSLPIVSMTADKQNGTVYTCSSDGKVRQLIPIFTDVALKFEHQLIKLSDVFGSVRTHGIAVSPCGAYLAIITTEGMINGLHPVNKNYQVQFVTLKTFEEQLLSSWNLQFKTFLSR

SEQ ID NO: 853913 - protein, 822 aa, Homo sapiens
MNTADQARVGPADDGPAPSGEEEGEGGGEAGGKEPAADAAPGPSAAFRLMVTRREPAVKLQYAVSGLEPLAWSEDHRVSVSTARSIAVLELICDVHNPGQDLVIHRTSVPAPLNSCLLKVGSKTEVAECKEKFAASKDPTVSQTFMLDRVFNPEGKALPPMRGFKYTSWSPMGCDANGRCLLAALTMDNRLTIQANLNRLQWVQLVDLTEIYGERLYETSYRLSKNEAPEGNLGDFAEFQRRHSMQTPVRMEWSGICTTQQVKHNNECRDVGSVLLAVLFENGNIAVWQFQLPFVGKESISSCNTIESGITSPSVLFWWEYEHNNRKMSGLIVGSAFGPIKILPVNLKAVKGYFTLRQPVILWKEMDQLPVHSIKCVPLYHPYQKCSCSLVVAARGSYVFWCLLLISKAGLNVHNSHVTGLHSLPIVSMTADKQNGTVYTCSSDGKVRQLIPIFTDVALKFEHQLIKLSDVFGSVRTHGIAVSPCGAYLAIITTEGMINGLHPVNKNYQVQFVTLKTFEEAAAQLLESSVQNLFKQVDLIDLVRWKILKDKHIPQFLQEALEKKIESSGVTYFWRFKLFLLRILYQSMQKTPSEALWKPTHEDSKILLVDSPGMGNADDEQQEEGTSSKQVVKQGLQERSKEGDVEEPTDDSLPTTGDAGGREPMEEKLLEIQGKIEAVEMHLTREHMKRVLGEVYLHTWITENTSIPTRGLCNFLMSDEEYDDRTARVLIGHISKKMNKQTFPEHCSLCKEILPFTDRKQAVCSNGHIWLRCFLTYQSCQSLIYRRCLLHDSIARHPAPEDPDWIKRLLQSPCPFCDSPVF

SEQ ID NO: 853914 - protein, 822 aa, Homo sapiens; identical to SEQ ID NO: 853913

SEQ ID NO: 853915 - protein, 234 aa, Homo sapiens
MNTADQARVGPADDGPAPSGEEEGEGGGEAGGKEPAADAAPGPSAAFRLMVTRREPAVKLQYAVSGLEPLAWSEDHRVSVSTARSIAVLELICDVHNPGQDLVIHRTSVPAPLNSCLLKVGSKTEVAECKEKFAASKDPTVSQTFMLDRVFNPEGKALPPMRGFKYTSWSPMGCDANGRCLLAALTMDNRLTIQANLTSAWARLETASKKKEKKCWYLDDTMTATSPPPPRIDR

SEQ ID NO: 853916 - protein, 142 aa, Homo sapiens
YTIQLGTPSTTAPVTTALVDSPGMGNADDEQQEEGTSSKQVVKQGLQERSKEGDVEEPTDDSLPTTGDAGGREPMEEKLLEIQGKIEAVEMHLTREHMKRVLGEVYLHTWITENTSIPTRGLCNFLMSDEEYDDRTARVGVY

SEQ ID NO: 853917 - protein, 822 aa, Homo sapiens; identical to SEQ ID NO: 853913

SEQ ID NO: 853918 - protein, 804 aa, Homo sapiens
MNTADQARVGPADDGPAPSGEEEGEGGGEAGGKEPAADAAPGPSAAFRLMVTRREPAVKLQYAVSGLEPLAWSEDHRVSVSTARSIAVLELICDVHNPGQDLVIHRTSVPAPLNSCLLKVGSKTEVAECKEKFAASKDPTVSQTFMLDRVFNPEGKALPPMRGFKYTSWSPMGCDANGRCLLAALTMDNRLTIQANLNRLQWVQLVDLTEIYGERLYETSYRLSKNEAPEGNLGDFAEFQRRHSMQTPVRMEWSGICTTQQVKHNNECRDVGSVLLAVLFENGNIAVWQFQLPFVGKESISSCNTIESGITSPSVLFWWEYEHNNRKMSGLIVGSAFGPIKILPVNLKAVKGYFTLRQPVILWKEMDQLPVHSIKCVPLYHPYQKCSCSLVVAARGSYVFWCLLLISKAGLNVHNSHVTGLHSLPIVSMTADKQNGTVYTCSSDGKVRQLIPIFTDVALKFEHQLIKLSDVFGSVRTHGIAVSPCGAYLAIITTEGMINGLHPVNKNYQVQFVTLKTFEEAAAQLLESSVQNLFKQVDLIDLVRWKILKDKHIPQFLQEALEKKIESSGVTYFWRFKLFLLRILYQSMQKTPSEALWKPTHEDSKILLVDSPGMGNADDEQQEEGTSSKQVVKQGLQERSKEGDVEEPTDDSLPTTGDAGGREPMEEKLLEIQGKIEAVEMHLTREHMKRVLGEVYLHTWITEYDDRTARVLIGHISKKMNKQTFPEHCSLCKEILPFTDRKQAVCSNGHIWLRCFLTYQSCQSLIYRRCLLHDSIARHPAPEDPDWIKRLLQSPCPFCDSPVF

SEQ ID NO: 853919 - protein, 138 aa, Homo sapiens
MNTADQARVGPADDGPAPSGEEEGEGGGEAGGKEPAADAAPGPSAAFRLMVTRREPAVKLQYAVSGLEPLAWSEDHRVSVSTARSIAVLELICDVHNPGQDLVIHRTSVPAPLNSCLLKVSHPPPSLGSSPVPLSRPH

SEQ ID NO: 853920 - protein, 1060 aa, Homo sapiens
GRAGLSQPRWSPGVREERGPRGGRGGGGGAGRASAGGRRSQGHRAPPLNMVAAHAAHSSSSAEWIACLDKRPLERSSEDVDIIFTRLKEVKAFEKFHPNLLHQICLCGYYENLEKGITLFRQGDIGTNWYAVLAGSLDVKVSETSSHQDAVTICTLGIGTAFGESILDNTPRHATIVTRESSELLRIEQKDFKALWEKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 853921 - protein, 652 aa, Homo sapiens
GRAGLSQPRWSPGVREERGPRGGRGGGGGAGRASAGGRRSQGHRAPPLNMVAAHAAHSSSSAEWIACLDKRPLERSSEDVDIIFTRLKEVKAFEKFHPNLLHQICLCGYYENLEKGITLFRQGDIGTNWYAVLAGSLDVKVSETSSHQDAVTICTLGIGTAFGESILDNTPRHATIVTRESSELLRIEQKDFKALWEKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLSSPSCLCSLKI

SEQ ID NO: 853922 - protein, 255 aa, Homo sapiens
MPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 853923 - protein, 255 aa, Homo sapiens; identical to SEQ ID NO: 853922

SEQ ID NO: 853924 - protein, 317 aa, Homo sapiens
ECRLSGEFRLYGPALWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 853925 - protein, 255 aa, Homo sapiens; identical to SEQ ID NO: 853922

SEQ ID NO: 853926 - protein, 150 aa, Homo sapiens
MSQETDGHLHVTGVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 853927 - protein, 255 aa, Homo sapiens; identical to SEQ ID NO: 853922

SEQ ID NO: 853928 - protein, 197 aa, Homo sapiens
MPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRAASPAAWAGEGTLQFSSMA

SEQ ID NO: 853929 - protein, 240 aa, Homo sapiens
MSGRGAGGFPLPPLSPGGGAVAAALGAPPPPAGPGMLPGPALRGPGPAGGVGGPGAAAFRPMGPAGPAAQYQRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGDPWGNPSRGQGGFLGTPSGRKTAG

SEQ ID NO: 853930 - protein, 105 aa, Homo sapiens [sequence omitted]

SEQ ID NO: 853931 - protein, 66 aa, Homo sapiens
GRGALLQARWRLICVVITVFLQMAVECLEEVPRGLQEGTISLPPVCPESCFHPSGPRNLQYPELQG

SEQ ID NO: 853932 - protein, 255 aa, Homo sapiens; identical to SEQ ID NO: 853922

SEQ ID NO: 853933 - protein, 297 aa, Homo sapiens
NEGLSSTMLSSTEGPQLNDGPQLNDGPQLNDGPPAHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 853934 - protein, 255 aa, Homo sapiens; identical to SEQ ID NO: 853922

SEQ ID NO: 853935 - protein, 255 aa, Homo sapiens
MPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIFLVWMENLRRTETQLFLTQAVPERAGPFAGARTATWSRDPARRELPPAGD

SEQ ID NO: 853936 - protein, 240 aa, Homo sapiens; identical to SEQ ID NO: 853929

SEQ ID NO: 853937 - protein, 111 aa, Homo sapiens
MADKVLPQRIRELVPESQAYMDLLAFERKLDQTIARKRMEIQEAIKKPLTVCVALTTSSLPRFPCLPPPCFPGAKQVGLEPGFSHAGCSPLVEYELSGMCWGQYVLNEYMT

SEQ ID NO: 853938 - protein, 138 aa, Homo sapiens
ETIESINQLKTQRDFMLSFSTDPQDFIQEWLRSQRRDLKVCPLSRGDSYVKLWVIFTHSSSQGGLAQGWGLCYGFPPGSLQIITDVIGNPEEERRAAFYHQPWAQEAVGRHIFAKVRLCPVFPPLAVSSKGLSHLVSP

SEQ ID NO: 853939 - protein, 311 aa, Homo sapiens
PVLPSLLALLHPLSHHPPLPSPPLPRPELPLPHLLQARSLRTITCPPKPTVLPPGTPLLKPPAPASPSPVRRGSPPAPSVPPPLQAPFPGFDSPRVYPSPPREVSGLSVCQSFRPSAPELQAASAIVSRAGGAGGPGAWVPAARAERPASQVLWPDPQEELLWVTMRETLEALSSLGFSVGQPEMAPQSEPREGSHNAQEQMSSSREERALGVCSGHEAPTPEEGAHTEQAEAPCRGQACSAQKAQPVGTCPVSRGPCHETAWGEQGDLGCCPKVWPPRDTCFLPAVSASAQHTQLGPPRTETQRTLAGNR

SEQ ID NO: 853940 - protein, 747 aa, Homo sapiens
PVLPSLLALLHPLSHHPPLPSPPLPRPELPLPHLLQARSLRTITCPPKPTVLPPGTPLLKPPAPASPSPVRRGSPPAPSVPPPLQAPFPGFDSPRVYPSPPREVSGLSVCQSFRPSAPELQAASAIVSRAGGAGGPGAWVPAARAERPASQVLWPDPQEELLWVTMRETLEALSSLGFSVGQPEMAPQSEPREGSHNAQEQMSSSREERALGVCSGHEAPTPEEGAHTEQAEAPCRGQACSAQKAQPVGTCPGEEWMIRKVKVEDEDQEAEEEVEWPQHLSLLPSPFPAPDLGHLAAAYKLEPGAPGALSGLALSGWGPMPEKPYGCGECERRFRDQLTLRLHQRLHRGEGPCACPDCGRSFTQRAHMLLHQRSHRGERPFPCSECDKRFSKKAHLTRHLRTHTGERPYPCAECGKRFSQKIHLGSHQKTHTGERPFPCTECEKRFRKKTHLIRHQRIHTGERPYQCAQCARSFTHKQHLVRHQRVHQTAGPARPSPDSSASPHSTAPSPTPSFPGPKPFACSDCGLSFGWKKNLATHQCLHRSEGRPFGCDECALGATVDAPAAKPLASAPGGPGCGPGSDPVVPQRAPSGERSFFCPDCGRGFSHGQHLARHPRVHTGERPFACTQCDRRFGSRPNLVAHSRAHSGARPFACAQCGRRFSRKSHLGRHQAVHTGSRPHACAVCARSFSSKTNLVRHQAIHTGSPSLSSPRRAGSVAPSGWLKATGLCSHSLHWGCRGERVTFARS

SEQ ID NO: 853941 - protein, 760 aa, Homo sapiens
PVLPSLLALLHPLSHHPPLPSPPLPRPELPLPHLLQARSLRTITCPPKPTVLPPGTPLLKPPAPASPSPVRRGSPPAPSVPPPLQAPFPGFDSPRVYPSPPREVSGLSVCQSFRPSAPELQAASAIVSRAGGAGGPGAWVPAARAERPASQVLWPDPQEELLWVTMRETLEALSSLGFSVGQPEMAPQSEPREGSHNAQEQMSSSREERALGVCSGHEAPTPEEGAHTEQAEAPCRGQACSAQKAQPVGTCPGEEWMIRKVKVEDEDQEAEEEVEWPQHLSLLPSPFPAPDLGHLAAAYKLEPGAPGALSGLALSGWGPMPEKPYGCGECERRFRDQLTLRLHQRLHRGEGPCACPDCGRSFTQRAHMLLHQRSHRGERPFPCSECDKRFSKKAHLTRHLRTHTGERPYPCAECGKRFSQKIHLGSHQKTHTGERPFPCTECEKRFRKKTHLIRHQRIHTGERPYQCAQCARSFTHKQHLVRHQRVHQTAGPARPSPDSSASPHSTAPSPTPSFPGPKPFACSDCGLSFGWKKNLATHQCLHRSEGRPFGCDECALGATVDAPAAKPLASAPGGPGCGPGSDPVVPQRAPSGERSFFCPDCGRGFSHGQHLARHPRVHTGERPFACTQCDRRFGSRPNLVAHSRAHSGARPFACAQCGRRFSRKSHLGRHQAVHTGSRPHACAVCARSFSSKTNLVRHQAIHTGSRPFSCPQCGKSFSRKTHLVRHQLIHGEAAHAAPDAALAAPAWSAPPEVAPPPLFF

SEQ ID NO: 853942 - protein, 553 aa, Homo sapiens
LEVSYSLPGHEAPTPEEGAHTEQAEAPCRGQACSAQKAQPVGTCPGEEWMIRKVKVEDEDQEAEEEVEWPQHLSLLPSPFPAPDLGHLAAAYKLEPGAPGALSGLALSGWGPMPEKPYGCGECERRFRDQLTLRLHQRLHRGEGPCACPDCGRSFTQRAHMLLHQRSHRGERPFPCSECDKRFSKKAHLTRHLRTHTGERPYPCAECGKRFSQKIHLGSHQKTHTGERPFPCTECEKRFRKKTHLIRHQRIHTGERPYQCAQCARSFTHKQHLVRHQRVHQTAGPARPSPDSSASPHSTAPSPTPSFPGPKPFACSDCGLSFGWKKNLATHQCLHRSEGRPFGCDECALGATVDAPAAKPLASAPGGPGCGPGSDPVVPQRAPSGERSFFCPDCGRGFSHGQHLARHPRVHTGERPFACTQCDRRFGSRPNLVAHSRAHSGARPFACAQCGRRFSRKSHLGRHQAVHTGSRPHACAVCARSFSSKTNLVRHQAIHTGSRPFSCPQCGKSFSRKTHLVRHQLIHGEAAHAAPDAALAAPAWSAPPEVAPPPLFF

SEQ ID NO: 853943 - protein, 103 aa, Homo sapiens
MIRKVKVEDEDQEAEEEVEWPQHLSLLPSPFPAPDLGHLAAAYKLEPGAPGALSGLALSGWGPMPEKPYGCGECERRFRDQLTLRLHQRLHRGEGPCACPDCG

SEQ ID NO: 853944 - protein, 557 aa, Homo sapiens
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNMMCQLSVVESKSATFPSEKARHLLDDSVLESRSPRRGLALTSSSAVTNGLSLGSSESSEFSEEMSSGLESPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQVPANLMSFE

SEQ ID NO: 853945 - protein, 209 aa, Homo sapiens
AAQALERTVPTAAGHRLRSRVCPRSSCAWPGPGPARRGPGLQAKAPLPLGRSQGHEEAAAATAARVKVTGRDCGGGESGGLLQTGYVTCRGCPEAPCGLETMYKRNGLMASVLVTSATPQGSSSSDSLEGQSCDYASKSYDAVVFDVLKVTPEEFASQITLMDIPVFKAIQPEKGWPARMEDSLQKSTVSSRPHDTLQFRKTLPVGPGT

SEQ ID NO: 853946 - protein, 616 aa, Homo sapiens
AAQALERTVPTAAGHRLRSRVCPRSSCAWPGPGPARRGPGLQAKAPLPLGRSQGHEEAAAATAARVKVTGRDCGGGESGGLLQTGYVTCRGCPEAPCGLETMYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNRGRLYATLGPNWRVPVRNSPRTRSCVYSPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQVPANLMSFE

SEQ ID NO: 853947 - protein, 658 aa, Homo sapiens
AAQALERTVPTAAGHRLRSRVCPRSSCAWPGPGPARRGPGLQAKAPLPLGRSQGHEEAAAATAARVKVTGRDCGGGESGGLLQTGYVTCRGCPEAPCGLETMYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNMMCQLSVVESKSATFPSEKARHLLDDSVLESRSPRRGLALTSSSAVTNGLSLGSSESSEFSEEMSSGLESPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQVPANLMSFE

SEQ ID NO: 853948 - protein, 628 aa, Homo sapiens
AAQALERTVPTAAGHRLRSRVCPRSSCAWPGPGPARRGPGLQAKAPLPLGRSQGHEEAAAATAARVKVTGRDCGGGESGGLLQTGYVTCRGCPEAPCGLETMYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNMMCQLSVVESKSATFPSEKARHLLDDSVLESRSPRRGLALTSSSAVTNGLSLGSSESSEFSEEMSSGLESPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQVPANLMSFE

SEQ ID NO: 853949 - protein, 630 aa, Homo sapiens
AAQALERTVPTAAGHRLRSRVCPRSSCAWPGPGPARRGPGLQAKAPLPLGRSQGHEEAAAATAARVKVTGRDCGGGESGGLLQTGYVTCRGCPEAPCGLETMYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNRGRLYATLGPNWRVPVRNSPRTRSCVYSPTGPCICSLGNSAAVPTMEGPLRRKTLLKEGRKPALSSWTRYWVILSGSTLLYYGAKSLRGTDRKHVSIVGWMVQLPDDPEHPDIFQLNNPDKGNVYKFQTGSRFHAILWHKHLDDACKSNRPQEAGAAPGPTGTDSHEVDHLEGGAGKEAGPCA

SEQ ID NO: 853950 - protein, 174 aa, Homo sapiens
AAQALERTVPTAAGHRLRSRVCPRSSCAWPGPGPARRGPGLQAKAPLPLGRSQGHEEAAAATAARVKVTGRDCGGGESGGLLQTGYVTCRGCPEAPCGLETMYKRNGLMASVLVTSATPQGSSSSDSLEGQSCDYASKSYDAVVFDVLKVTPEEFASQITLMDIPVFKAIQPEE

SEQ ID NO: 853951 - protein, 658 aa, Homo sapiens; identical to SEQ ID NO: 853947

SEQ ID NO: 853952 - protein, 177 aa, Homo sapiens
VYWPGSSSRGRLYATLGPNWRVPVRNSPRTRSCVYSPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQVPANLMSFE

SEQ ID NO: 853953 - protein, 323 aa, Homo sapiens
AAQALERTVPTAAGHRLRSRVCPRSSCAWPGPGPARRGPGLQAKAPLPLGRSQGHEEAAAATAARVKVTGRDCGGGESGGLLQTGYVTCRGCPEAPCGLETMYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIQLLCVWQSCEEARVARD

SEQ ID NO: 853954 - protein, 177 aa, Homo sapiens
MVGFGANRRAGRLPSLVLVVLLVVIVVLAFNYWSISSRHVLLQEEVAELQGQVQRTEVARGRLEKRNSDLLLLVDTHKKQIDQKEADYGRLSSRLQAREGLGKRCEDDKVKLQNNISYQMADIHHLKEQLAELRQEFLRQEDQLQDYRKNNTYLVKRLEYESKRPKRFNQMMERNWI

SEQ ID NO: 853955 - protein, 136 aa, Homo sapiens
MVGFGANRRAGRLPSLVLVVLLVVIVVLAFNYWSISSRHVLLQEEVAELQGQVQRTEVARGRLEKRNSDLLLLVDTHKKQIDQKEADYGRLSSRLQAREGLGKRCEDDKSNLLSFVRNFFDKKTSFRTIGRTILTL

SEQ ID NO: 853956 - protein, 186 aa, Homo sapiens
MPGIEENDLAKVDDLPPALRKPPISVSQHESHQAISHLPTGQPLSPNMPPDSHINHNGNPGTSKQNPSSPLQRLIPGSNLDSEPRIQTDILKQATKDRVSDFHKLKQSRFFDENESPVDPQHGSKLADYNGDDGNVGEYEADKQAELAYNEEEDGDGGEEDVQDDEERELQMDPADYGKQHFNDVL

SEQ ID NO: 853957 - protein, 436 aa, Homo sapiens [sequence omitted]

SEQ ID NO: 853958 - protein, 436 aa, Homo sapiens [sequence omitted]

SEQ ID NO: 853959 - protein, 436 aa, Homo sapiens [sequence omitted]

SEQ ID NO: 853960 - protein, 273 aa, Homo sapiens
MVGFGANRRAGRLPSLVLVVLLVVIVVLAFNYWSISSRHVLLQEEVAELQGQVQRTEVARGRLEKRNSDLLLLVDTHKKQIDQKEADYGRLSSRLQAREGLGKRCEDDKVKLQNNISYQMADIHHLKEQLAELRQEFLRQEDQLQDYRKNNTYLVKRLEYESFQCGQQMKELRAQHEENIKKLADQFLEEQKQETQKIQSNDGKELDINNQVVPKNIPKVAENVADKNEEPSSNHIPHGKEQIKRGGDAGMPGIEENDLAKVDDLPPASRKSF

SEQ ID NO: 853961 - protein, 436 aa, Homo sapiens [sequence omitted]

SEQ ID NO: 853962 - protein, 380 aa, Homo sapiens
MVGFGANRRAGRLPSLVLVVLLVVIVVLAFNYWSISSRHVLLQEEVAELQGQVQRTEVARGRLEKRNSDLLLLVDTHKKQIDQKEADYGRLSSRLQAREGLGKRCEDDKVKLQNNISYQMADIHHLKEQLAELRQEFLRQEDQLQDYRKNNTYLVKRLEYESFQCGQQMKELRAQHEENIKKLADQFLEEQKQETQKIQSNDGKELDINNQVVPKNIPKVAENVADKNEEPSSNHIPHGKEQIKRGGDAGMPGIEENDLAKVDDLPPALRKPPISVSQHESHQAISHLPTGQPLSPNMPPDSHINHNGNPGTSKQNPSSPLQRLIPGSNLDSEPRIQTDILKQATKDRVSDFHKLKQNDEERELQMDPADYGKQHFNDVL

SEQ ID NO: 853963 - protein, 436 aa, Homo sapiens [sequence omitted]

SEQ ID NO: 853964 - protein, 436 aa, Homo sapiens [sequence omitted]

SEQ ID NO: 853965 - protein, 436 aa, Homo sapiens [sequence omitted]

SEQ ID NO: 853966 - protein, 269 aa, Homo sapiens
MVGFGANRRAGRLPSLVLVVLLVVIVVLAFNYWSISSRHVLLQEEVAELQGQVQRTEVARGRLEKRNSDLLLLVDTHKKQIDQKEADYGRLSSRLQAREGLGKRCEDDKVKLQNNISYQMADIHHLKEQLAELRQEFLRQEDQLQDYRKNNTYLVKRLEYESFQCGQQMKELRAQHEENIKKLADQFLEEQKQETQKIQSNDGKELDINNQVVPKNIPKVAENVADKNEEPSSNHIPHGKEQIKRGGDAGMPGIEENDLAKVDDLPPVL

SEQ ID NO: 853967 - protein, 365 aa, Homo sapiens
FIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVLVGRVETGVLKPGMVVTFAPVNVTTEVKSVEMHHEALSEALPGDNVGFNVKNVSVKDVHRGNVAGDSKNDPPMEAAGFTAQVIILNHPGQISAGYAPVLDCHTAHIACKFAELKEKIDRRSGKKLEDGPKFLKSGDAAIADMVPGKPMCVESFSDYPPLGRFAVRDMRQTVAVGVIKAVDKKAAGAGKVTKSAQKAQKAK

SEQ ID NO: 853968 - protein, 245 aa, Homo sapiens
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKMPGRLGPQRLLFQNLWKPRLNVP

SEQ ID NO: 853969 - protein, 302 aa, Homo sapiens
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKMPGRLAPRSFKLWKRVMCMTFLWMDIMKWVIEAWLWVHRNLCPQDGDLCLKVDAGHTVDIRAQKKPALGRKGRSAFRSLV

SEQ ID NO: 853970 - protein, 136 aa, Homo sapiens
LGLGRRKPCGTGFPAGIRLRDLAWTGGEEGAGEQWIPESRRPQGRPNRGRRAGPGGGVAVPPGRGRFSDAPPWWMRIACDVEGWGPRRFGCFRSLAALPLNPAFPTHSLSPLSLSFLICRVGTVTPFVVEFGGCNE

SEQ ID NO: 853971 - protein, 245 aa, Homo sapiens; identical to SEQ ID NO: 853968

SEQ ID NO: 853972 - protein, 245 aa, Homo sapiens; identical to SEQ ID NO: 853968

SEQ ID NO: 853973 - protein, 233 aa, Homo sapiens
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKYVLGGYGRTCP

SEQ ID NO: 853974 - protein, 322 aa, Homo sapiens
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKAWEEFHGLVNSMRPLIGRSPSVSHTQGTIQAFEIQKSHCESTQAGNNPFLYVCVCPKWMGGLQPVLPLLTEGTSLSRALSFCTHSWRTDSARHPPASLTL

SEQ ID NO: 853975 - protein, 322 aa, Homo sapiens; identical to SEQ ID NO: 853974

SEQ ID NO: 853976 - protein, 222 aa, Homo sapiens
MVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKAWEEFHGLVNSMRPLIGRSPSVSHTQGTIQAFEIQKSHCESTQAGNNPFLYVCVCPKWMGGLQPVLPLLTEGTSLSRALSFCTHSWRTDSARHPPASLTL

SEQ ID NO: 853977 - protein, 374 aa, Homo sapiens
LGLGRRKPCGTGFPAGIRLRDLAWTGGEEGAGEQWIPESRRPQGRPNRGRRAGPGGGVAVPPGRGRFSDAPPWWMRIACDVEGWGPRRFGCFRSLAALPLNPAFPTHSLSPLSLSFLICRVGTVTPFVVELEDAMSLKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKMPGRLGPQRLLFQNLWKPRLNVP

SEQ ID NO: 853978 - protein, 245 aa, Homo sapiens; identical to SEQ ID NO: 853968

SEQ ID NO: 853979 - protein, 322 aa, Homo sapiens; identical to SEQ ID NO: 853974

SEQ ID NO: 853980 - protein, 234 aa, Homo sapiens
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKDNSSFRNTKITL

SEQ ID NO: 853981 - protein, 322 aa, Homo sapiens; identical to SEQ ID NO: 853974

SEQ ID NO: 853982 - protein, 322 aa, Homo sapiens; identical to SEQ ID NO: 853974

SEQ ID NO: 853983 - protein, 322 aa, Homo sapiens; identical to SEQ ID NO: 853974

SEQ ID NO: 853984 - protein, 322 aa, Homo sapiens; identical to SEQ ID NO: 853974

SEQ ID NO: 853985 - protein, 252 aa, Homo sapiens
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKARSSSSLSQPCLQDLRVTALPFLLGPVLLH

SEQ ID NO: 853986 - protein, 451 aa, Homo sapiens
LGLGRRKPCGTGFPAGIRLRDLAWTGGEEGAGEQWIPESRRPQGRPNRGRRAGPGGGVAVPPGRGRFSDAPPWWMRIACDVEGWGPRRFGCFRSLAALPLNPAFPTHSLSPLSLSFLICRVGTVTPFVVELEDAMSLKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKAWEEFHGLVNSMRPLIGRSPSVSHTQGTIQAFEIQKSHCESTQAGNNPFLYVCVCPKWMGGLQPVLPLLTEGTSLSRALSFCTHSWRTDSARHPPASLTL

SEQ ID NO: 853987 - protein, 338 aa, Homo sapiens
RIHKNRQVRSRILVRRMNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKAWEEFHGLVNSMRPLIGRSPSVSHTQGTIQAFEIQKSHCESTQAGNNPFLYVCVCPKWMGGLQPVLPLLTEGTSLSRALSFCTHSWRTDSARHPPASLTL

SEQ ID NO: 853988 - protein, 183 aa, Homo sapiens
QEGSDVIGKQALYPWQRPWQAGWVPAVADPGEAACLHQPGLQRAAAAGPAAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 853989 - protein, 129 aa, Homo sapiens
QEGSDVIGKQALYPWQRPWQAGWVPAVADPGEAACLHQPGLQRAAAAGPAAMAKDILGEAGLHFDELNKLRVLDPEVTQQTIELKEECKDFVDSEYWGDTVPLSFELPFQLYPRLILALPQWSCWLPGG

SEQ ID NO: 853990 - protein, 195 aa, Homo sapiens
QEGSDVIGKQALYPWQRPWQAGWVPAVADPGEAACLHQPGLQRAAAAGPAEQNSSREPGWETAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 853991 - protein, 122 aa, Homo sapiens
MTHLLLTATVTPSEQNSSREPGWETAMAKDILGEAGLHFDELNKLRVLDPEVTQQTIELKEECKDFVDKIGQFQKIVGGLIELVDQLAKEAENEKMKVRSACLPPTSWPGTLVHYPLIPLPS

SEQ ID NO: 853992 - protein, 132 aa, Homo sapiens
MTHLLLTATVTPSEQNSSREPGWETAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLER

SEQ ID NO: 853993 - protein, 157 aa, Homo sapiens
QEGSDVIGKQALYPWQRPWQAGWVPAVADPGEAACLHQPGLQRAAAAGPAAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLER

SEQ ID NO: 853994 - protein, 125 aa, Homo sapiens
QEGSDVIGKQALYPWQRPWQAGWVPAVADPGEAACLHQPGLQRAAAAGPAAMAKDILGEAGLHFDELNKLRVLDPEVTQQTIELKEECKDFVDKIGQFQKIVGGLIELVDQLAKEAENEKMKVSG

SEQ ID NO: 853995 - protein, 122 aa, Homo sapiens; identical to SEQ ID NO: 853991

SEQ ID NO: 853996 - protein, 197 aa, Homo sapiens
QEGSDVIGKQALYPWQRPWQAGWVPAVADPGEAACLHQPGLQRAAAAGPAAMAKDILGEAGLHFDELNKLRVLDPEVTQQTIELKEECKDFVDKIGQFQKIVGGLIELVDQLAKEAENEKMKSLAVSPRLECTGAISAHCKLCLSDSSDSPTSPSRVGGSHRCSELAQIYSKAERSSTAATSSPNSRKENAARKVSG

SEQ ID NO: 853997 - protein, 158 aa, Homo sapiens
MTHLLLTATVTPSEQNSSREPGWETAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 853998 - protein, 147 aa, Homo sapiens
QEGSDVIGKQALYPWQRPWQAGWVPAVADPGEAACLHQPGLQRAAAAGPAAMAKDILGEAGLHFDELNKLRVLDPEVTQQTIELKEECKDFVDKIGQFQKIVGGLIELVDQLAKEAENEKMKVRSACLPPTSWPGTLVHYPLIPLPS

SEQ ID NO: 853999 - protein, 141 aa, Homo sapiens
MTHLLLTATVTPSEQNSSREPGWETAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERNSISLVILI

SEQ ID NO: 854000 - protein, 76 aa, Homo sapiens
QEGSDVIGKQALYPWQRPWQAGWVPAVADPGEAACLHQPGLQRAAAAGPAAELCALQGGHRVAFIFVPPASSSVGM

SEQ ID NO: 854001 - protein, 183 aa, Homo sapiens; identical to SEQ ID NO: 853988

SEQ ID NO: 854002 - protein, 220 aa, Homo sapiens
HDRRWHMRNSETLERGVGGCRVFSCLGSYPGIEGAGLALLAGLALGGRLLGTHMSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICSIQ

SEQ ID NO: 854003 - protein, 248 aa, Homo sapiens
DDGGRAGVMSSTRLSAIINQRDLPETVPYLKIFTVGHQVPDDETIFKFKHAVNGFLKENKDNDKLIGVHCTHGLNRTGYLICRYLIDVEGVRPDDAIELFNRCRGHCLERQNYIEDLQNGPIRKNWNSSVPRSSDFEDSAHLMQPVHNKPVKQGPRYNLHQIQGHSAPRHFHTQTQSLQQSVRKFSENPHVYQRHHLPPPGPPGEDYSHRRYSWNVKPNASRAAQDRRRWYPYNYSRLSYPACWEWTQ

SEQ ID NO: 854004 - protein, 383 aa, Homo sapiens
HDRRWHMRNSETLERGVGGCRVFSCLGSYPGIEGAGLALLAGLALGGRLLGTHMSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRYLIDVEGVRPDDAIELFNRCRGHCLERQNYIEDLQNGPIRKNWNSSVPRSSDFEDSAHLMQPVHNKPVKQGPRYNLHQIQGHSAPRHFHTQTQSLQQSVRKFSENPHVYQRHHLPPPGPPGEDYSHRRYSWNVKPNASRAAQDRRRWYPYNYSRLSYPACWEWTQ

SEQ ID NO: 854005 - protein, 383 aa, Homo sapiens; identical to SEQ ID NO: 854004

SEQ ID NO: 854006 - protein, 324 aa, Homo sapiens
HDRRWHMRNSETLERGVGGCRVFSCLGSYPGIEGAGLALLAGLALGGRLLGTHMSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRYLIDVEGVRPDDAIELFNRCRGHCLERQNYIEDLQNGPIRKKFSENPHVYQRHHLPPPGPPGEDYSHRRYSWNVKPNASRAAQDRRRWYPYNYSRLSYPACWEWTQ

SEQ ID NO: 854007 - protein, 279 aa, Homo sapiens
HDRRWHMRNSETLERGVGGCRVFSCLGSYPGIEGAGLALLAGLALGGRLLGTHMSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRRSLALSPRLECSGTISTHSKFCFPGSRRSPASASQVAGTTGARHHARLIFCIFSRDVVSPC

SEQ ID NO: 854008 - protein, 66 aa, Homo sapiens
SPTPPPLPPPHPRPNRLVRGLVLLRVVMALTYEEKPPYAMLRNNLEALLQDLRVSPYDPIGLPMVP

SEQ ID NO: 854009 - protein, 474 aa, Homo sapiens
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKFVDKPGPFVGPCGHWIRPSETLQKYLKVVMALTYEEKPPYAMLRNNLEALLQDLRVSPYDPIGLPMVP

SEQ ID NO: 854010 - protein, 474 aa, Homo sapiens; identical to SEQ ID NO: 854009

SEQ ID NO: 854011 - protein, 474 aa, Homo sapiens; identical to SEQ ID NO: 854009

SEQ ID NO: 854012 - protein, 412 aa, Homo sapiens
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKLPWDSF

SEQ ID NO: 854013 - protein, 463 aa, Homo sapiens
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKNKARSPSAVCSFPPPPSSSVWLTQISPLCSRLRGTTSLPLSQPQTAYLTAPLAPTFH

SEQ ID NO: 854014 - protein, 474 aa, Homo sapiens; identical to SEQ ID NO: 854009

SEQ ID NO: 854015 - protein, 474 aa, Homo sapiens; identical to SEQ ID NO: 854009

SEQ ID NO: 854016 - protein, 412 aa, Homo sapiens; identical to SEQ ID NO: 854012

SEQ ID NO: 854017 - protein, 412 aa, Homo sapiens; identical to SEQ ID NO: 854012

SEQ ID NO: 854018 - protein, 437 aa, Homo sapiens
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQNLGDKARLRLGLVAQVIWEAAGHLRLKCRSEV

SEQ ID NO: 854019 - protein, 424 aa, Homo sapiens
MISFCPDCGKSIQAAFKFCPYCGNSLPVEEHVGSQTFVNPHVSSFQGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKFVDKPGPFVGPCGHWIRPSETLQKYLKVVMALTYEEKPPYAMLRNNLEALLQDLRVSPYDPIGLPMVP

SEQ ID NO: 854020 - protein, 424 aa, Homo sapiens; identical to SEQ ID NO: 854019

SEQ ID NO: 854021 - protein, 230 aa, Homo sapiens [sequence omitted]

SEQ ID NO: 854022 - protein, 254 aa, Homo sapiens
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLSTSGRSCTRPHCWPSLPAWVSVFTRTNTASRSGGTQPGEELNGLVFAKHV

SEQ ID NO: 854023 - protein, 188 aa, Homo sapiens
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTWNVHSCHWFQDTHQS

SEQ ID NO: 854024 - protein, 101 aa, Homo sapiens
VQHQEQQAAGHKREVLGMWVQHQGQRSTKGKRCGYEFSTKDSGQLILAGVLGMHFRHEYQLPRPGTVVHALIPALWEAKADGSRGQQFETSLANIVKLCLY

SEQ ID NO: 854025 - protein, 474 aa, Homo sapiens; identical to SEQ ID NO: 854009

SEQ ID NO: 854026 - protein, 474 aa, Homo sapiens; identical to SEQ ID NO: 854009

SEQ ID NO: 854027 - protein, 474 aa, Homo sapiens; identical to SEQ ID NO: 854009

SEQ ID NO: 854028 - protein, 412 aa, Homo sapiens; identical to SEQ ID NO: 854012

SEQ ID NO: 854029 - protein, 243 aa, Homo sapiens
MKLHPPPPSPVTQDHRSKSSHSNWFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKFVDKPGPFVGPCGHWIRPSETLQKYLKVVMALTYEEKPPYAMLRNNLEALLQDLRVSPYDPIGLPMVP

SEQ ID NO: 854030 - protein, 504 aa, Homo sapiens
CVFFVSRMCTSSRRVVESSPVISADRDPLSMISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKFVDKPGPFVGPCGHWIRPSETLQKYLKVVMALTYEEKPPYAMLRNNLEALLQDLRVSPYDPIGLPMVP

SEQ ID NO: 854031 - protein, 269 aa, Homo sapiens
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYSTFWCTSWGEAQSAG

SEQ ID NO: 854032 - protein, 188 aa, Homo sapiens; identical to SEQ ID NO: 854023

SEQ ID NO: 854033 - protein, 419 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 854034 - protein, 76 aa, Homo sapiens
SPFLLRASGALAKAGRFRTQVTWAASWTVSTPPSSSTAGSDPTPCVRTPLVQRHILFTKLDCALSRSLNSSEMPHI

SEQ ID NO: 854035 - protein, 419 aa, Homo sapiens; identical to SEQ ID NO: 854033

SEQ ID NO: 854036 - protein, 320 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRRKLAQLQVAYHQLFQEYDNHIKSSVVGSERKRADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 854037 - protein, 407 aa, Homo sapiens
MVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 854038 - protein, 294 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRPGRPRSRPRPLHRARERCDTPTPRSCTHLTSGPQPWTVGPGMTSQGRLRTKGSGPIAAPIPVQHRTTSHPRPTAPPPDINPRAAPATGQPPRPITRTHHAPHPVPAPHQTTPRNPPPTPPT

SEQ ID NO: 854039 - protein, 376 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRPGRLSEALRSWHLTPSSPLEPAPLREAGQTSGGHGRRIELGERPRIPDHSRDNDWPLEALHHRRQSHRQIIINHRPQKMVQKLAQTEDAALDSLERLATTIAPGSGRKQDRQGPKTSDRTPSAGATWEIPKPGSTDTRAEGPRGRTPTPPPHEGVGQHRGKRTAKRRRGTRPRAAQDRGKEHTQQATERDHRDERHAPHHGSS

SEQ ID NO: 854040 - protein, 73 aa, Homo sapiens
MVQPSGGPAADQDVLGEESPLGKPAMLHLPSEQGAPETLQRCLEENQELRGMWVPAGQAIGGYGPPPAGRGAP

SEQ ID NO: 854041 - protein, 419 aa, Homo sapiens; identical to SEQ ID NO: 854033

SEQ ID NO: 854042 - protein, 487 aa, Homo sapiens
MALVIQVGKLRPREVRTPQTINPSLFPSLPVKLSSIIEVPSGGEGCCSRRTLVYKARAFWKGAPLPCWMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 854043 - protein, 419 aa, Homo sapiens; identical to SEQ ID NO: 854033

SEQ ID NO: 854044 - protein, 407 aa, Homo sapiens; identical to SEQ ID NO: 854037

SEQ ID NO: 854045 - protein, 162 aa, Homo sapiens [sequence omitted]

SEQ ID NO: 854046 - protein, 272 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRRKLAQLQVAYHQLFQEYDNHIKSSVVGSERKRGMQLEDLKQQLQQAEEALVAKQEVIDKLKEEAEQHKIVMETVPVLKAQRISSGLQAESRPGKLAKKR

SEQ ID NO: 854047 - protein, 827 aa, Homo sapiens
TGGAAATPPPPRRNLRGPEAACFLFVRRGDMAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 854048 - protein, 314 aa, Homo sapiens
MDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFSWEVRLGSPPGPPCDNVLGTGLGNLEGRGAGGPNARGE

SEQ ID NO: 854049 - protein, 123 aa, Homo sapiens
MSFLFRLINIIHVQTLTQVRGPGRHTAGKVDWKPLPLSWCPAGFCPPLQKCVSGDPALLRTVLRRNQCPIVQTGPKEGGLASALRSQADLQASALPASPMSTSLTPSALLGFGIGPEAAQLPH

SEQ ID NO: 854050 - protein, 710 aa, Homo sapiens
KTKTAKVARPGCEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 854051 - protein, 399 aa, Homo sapiens
MRSQSTIKVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 854052 - protein, 999 aa, Homo sapiens
TGGAAATPPPPRRNLRGPEAACFLFVRRGDMAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPVSRRPPGTDGASLAWSSCFKTCCCPFDLFSFGSRAETKIISYSPLIGSYLGVGSEGTPLPTPTYAEIPFKIFLGWAQCLGLPKCCDYRCNHHAPPYFLLSVMACFEQEGGHISLICCGSDVEVNRWFSNYRKVLMVHEDRGLEKQAPTRVSACVILEPCGCGPNIEAVHVFQDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 854053 - protein, 532 aa, Homo sapiens
AYYYYYYYYNERPLDPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 854054 - protein, 677 aa, Homo sapiens
TGGAAATPPPPRRNLRGPEAACFLFVRRGDMAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKGT

SEQ ID NO: 854055 - protein, 385 aa, Homo sapiens
MVHEDRGLEKQAPTRVSACVILEPCGCGPNIEAVHVFQDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 854056 - protein, 813 aa, Homo sapiens
TGGAAATPPPPRRNLRGPEAACFLFVRRGDMAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALISSV

SEQ ID NO: 854057 - protein, 827 aa, Homo sapiens; identical to SEQ ID NO: 854047

SEQ ID NO: 854058 - protein, 827 aa, Homo sapiens; identical to SEQ ID NO: 854047

SEQ ID NO: 854059 - protein, 827 aa, Homo sapiens; identical to SEQ ID NO: 854047

SEQ ID NO: 854060 - protein, 786 aa, Homo sapiens
TGGAAATPPPPRRNLRGPEAACFLFVRRGDMAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENAAPA

SEQ ID NO: 854061 - protein, 697 aa, Homo sapiens
TGGAAATPPPPRRNLRGPEAACFLFVRRGDMAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTPYWPAGQYGCGEDGKLQEMQLKEAKHIAEDSDRKY

SEQ ID NO: 854062 - protein, 134 aa, Homo sapiens
AYYYYYYYKLAAADPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCAAPA

SEQ ID NO: 854063 - protein, 102 aa, Homo sapiens [sequence omitted]

SEQ ID NO: 854064 - protein, 819 aa, Homo sapiens
TGGAAATPPPPRRNLRGPEAACFLFVRRGDMAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 854065 - protein, 542 aa, Homo sapiens
MDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 854066 - protein, 677 aa, Homo sapiens; identical to SEQ ID NO: 854054

SEQ ID NO: 854067 - protein, 694 aa, Homo sapiens
TGGAAATPPPPRRNLRGPEAACFLFVRRGDMAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKVKLTQGSVECAGLSRSSPGVLVCQALGTGFTLETTGESGQSLANIHWNLLCLALC

SEQ ID NO: 854068 - protein, 827 aa, Homo sapiens; identical to SEQ ID NO: 854047

SEQ ID NO: 854069 - protein, 827 aa, Homo sapiens; identical to SEQ ID NO: 854047

SEQ ID NO: 854070 - protein, 827 aa, Homo sapiens; identical to SEQ ID NO: 854047

SEQ ID NO: 854071 - protein, 774 aa, Homo sapiens
TGGAAATPPPPRRNLRGPEAACFLFVRRGDMAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYAAPA

SEQ ID NO: 854072 - protein, 503 aa, Homo sapiens
TGGAAATPPPPRRNLRGPEAACFLFVRRGDMAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPVSRRPPGTDGASLAWSSCFKTCC

SEQ ID NO: 854073 - protein, 94 aa, Homo sapiens
QTSKYLTEGPVPIRRREDLGDGQRLSPTPTGAAESELAFPSFLLQCFLGALWLALSGTLFSTPGPLRASSHSLQDPVHTEKIPEEPPAPPQLPV

SEQ ID NO: 854074 - protein, 960 aa, Homo sapiens
RGSSGVRRRGREAAMAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 854075 - protein, 934 aa, Homo sapiens
RGSSGVRRRGREAAMAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 854076 - protein, 939 aa, Homo sapiens
RGSSGVRRRGREAAMAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKSRRAASPAPAPSITRDSWGRHGEVYPGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 854077 - protein, 183 aa, Homo sapiens
EGLGWAREQSLSDHSWLARRLLALDPVQEKEHSKQAGPSHRRTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 854078 - protein, 535 aa, Homo sapiens
RGSSGVRRRGREAAMAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQQQFANTT

SEQ ID NO: 854079 - protein, 102 aa, Homo sapiens
SARLCVRGSMASGEVHGSGRWRVDKAVAQNMDSVFKELLGKTSVRQGLGPASTTSPSPGPRSPKAPPSSRLGRNKGFSRGPGAPASPSASHPQGLDTTPKPH

SEQ ID NO: 854080 - protein, 960 aa, Homo sapiens; identical to SEQ ID NO: 854074

SEQ ID NO: 854081 - protein, 962 aa, Homo sapiens
CKGGCHLPEPGYRRERKSQGKPFRGFPGTRERQEAKLKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 854082 - protein, 988 aa, Homo sapiens
RGSSGVRRRGREAAMAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGYTLGAAEGTGGSTGEEPPSSASSALNLRDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 854083 - protein, 39 aa, Homo sapiens
MDSRAVHVTVGVCGESVYVSVLPPHPPLPGSKETPCHVE

SEQ ID NO: 854084 - protein, 139 aa, Homo sapiens
RGSSGVRRRGREAAMAAHGKLRRERGLQAEYETQVKGERAPGAPGPFPAENPRSCGSSKRPRRLSHIAEDVGRLVKKLDRQTIETEEVNKTLKATLQALLEVVASDDGDVLDSFQTSPSTESLKSTPGRAGWRFIKTSC

SEQ ID NO: 854085 - protein, 137 aa, Homo sapiens
MMIDLAKVADLVLMLIDASFGFEMEMFEFLNICQAHGFPKILGVLTHLDSFKHNKQLKKTKKRLKHRFWTEVYQVAKLFYLSGMVHGEYQNQEIHNLGHFITVMKFRPLMANFSPLYPGRQDGRFDKPGGYPNKHQM

SEQ ID NO: 854086 - protein, 137 aa, Homo sapiens; identical to SEQ ID NO: 854085

SEQ ID NO: 854087 - protein, 344 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 854088 - protein, 359 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEDTEAQGIFIDLSEDLENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 854089 - protein, 291 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHGLRNIPVYTINRIVILPSLDRSQTSSLSYLPAHQDSCVPLDAALHVVLYFWSLLGLQSYLSCF

SEQ ID NO: 854090 - protein, 344 aa, Homo sapiens; identical to SEQ ID NO: 854087

SEQ ID NO: 854091 - protein, 345 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEDRVSLLPPRL

SEQ ID NO: 854092 - protein, 345 aa, Homo sapiens; identical to SEQ ID NO: 854091

SEQ ID NO: 854093 - protein, 241 aa, Homo sapiens
MIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 854094 - protein, 315 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 854095 - protein, 212 aa, Homo sapiens
MIVEIPRWTNAKMEIATKEPMNPIKQYVKDGKLRYVANIFPYKGYIWNYGTLPQILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 854096 - protein, 242 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 854097 - protein, 167 aa, Homo sapiens
RAHSRTVIDAMSALLRLLRTGAPAAACLRLGTSAGTGSRRAMALYHTEERGQPCSQNYRLFFRPSAVAARSRPPYFPRERAPSHENCQRGGGGSRPQSGEQRRRAAGWGVDSALCPASRPPRGVGRVQAATPRRPAAISRPGRRSRFTQLSEEGKAEPAHTPAFLEA

SEQ ID NO: 854098 - protein, 143 aa, Homo sapiens
IHASGPTRPVGGRYGEEENGTFFLHLLYIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 854099 - protein, 344 aa, Homo sapiens; identical to SEQ ID NO: 854087

SEQ ID NO: 854100 - protein, 255 aa, Homo sapiens
MKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 854101 - protein, 255 aa, Homo sapiens; identical to SEQ ID NO: 854100

SEQ ID NO: 854102 - protein, 326 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEENGIPMKKARNDEYEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 854103 - protein, 167 aa, Homo sapiens; identical to SEQ ID NO: 854097

SEQ ID NO: 854104 - protein, 178 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQVSSSPNKESNEEEQVWHFLGK

SEQ ID NO: 854105 - protein, 176 aa, Homo sapiens
CGWGPVQGPGRAVLWPCTTLRSAASPARRITASSLVSSSRRFAERRTGETWVGDGMGDTWDAPRGLPSLFLGPSAVAARSRPPYFPRERAPSHENCQRGGGGSRPQSGEQRRRAAGWGVDSALCPASRPPRGVGRVQAATPRRPAAISRPGRRSRFTQLSEEGKAEPAHTPAFLEA

SEQ ID NO: 854106 - protein, 673 aa, Homo sapiens
RQRNATSSLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVTAAPPASACSSWSLLTSGMARTWRTCRSSSRSKGSVPLTTSQLLAPGSSSVGTWITSPTTCSLVPSTLKTARPTPCAMPSLRSLAPSLTLPATTRNMASGGW

SEQ ID NO: 854107 - protein, 745 aa, Homo sapiens
RQRNATSSLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYVSAHIPLPISPTPCCVMPPGGTSPEACWAGAGAGPSGCPGVPVQHFVLQPPHHPFPSDSHPPLTFCLPLSLAAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVTAAPPASACSSWSLLTSGMARTWRTCRSSSRSKGSVPLTTSQLLAPGSSSVGTWITSPTTCSLVPSTLKTARPTPCAMPSLRSLAPSLTLPATTRNMASGGW

SEQ ID NO: 854108 - protein, 673 aa, Homo sapiens; identical to SEQ ID NO: 854106

SEQ ID NO: 854109 - protein, 660 aa, Homo sapiens
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVTAAPPASACSSWSLLTSGMARTWRTCRSSSRSKGSVPLTTSQLLAPGSSSVGTWITSPTTCSLVPSTLKTARPTPCAMPSLRSLAPSLTLPATTRNMASGGW

SEQ ID NO: 854110 - protein, 386 aa, Homo sapiens
IVIADSRVYPADPQDCFGTTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVTAAPPASACSSWSLLTSGMARTWRTCRSSSRSKGSVPLTTSQLLAPGSSSVGTWITSPTTCSLVPSTLKTARPTPCAMPSLRSLAPSLTLPATTRNMASGGW

SEQ ID NO: 854111 - protein, 327 aa, Homo sapiens
IRHRIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVTAAPPASACSSWSLLTSGMARTWRTCRSSSRSKGSVPLTTSQLLAPGSSSVGTWITSPTTCSLVPSTLKTARPTPCAMPSLRSLAPSLTLPATTRNMASGGW

SEQ ID NO: 854112 - protein, 268 aa, Homo sapiens
MGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVTAAPPASACSSWSLLTSGMARTWRTCRSSSRSKGSVPLTTSQLLAPGSSSVGTWITSPTTCSLVPSTLKTARPTPCAMPSLRSLAPSLTLPATTRNMASGGW

SEQ ID NO: 854113 - protein, 152 aa, Homo sapiens [sequence omitted]

SEQ ID NO: 854114 - protein, 673 aa, Homo sapiens; identical to SEQ ID NO: 854106

SEQ ID NO: 854115 - protein, 701 aa, Homo sapiens
RQRNATSSLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVTAAPPASACSSWSLLTSGMARTWRTCRSSSRSKGSVPLTTSQLLAPGSSSVGTWITSPTTCSLVPSTLKTARPTPCAMPSLRSLAPSLTLPATTSHGFLFQDGVTRHASCSPLSPRSDCGCGGGVLKITF

SEQ ID NO: 854116 - protein, 673 aa, Homo sapiens; identical to SEQ ID NO: 854106

SEQ ID NO: 854117 - protein, 673 aa, Homo sapiens; identical to SEQ ID NO: 854106

SEQ ID NO: 854118 - protein, 359 aa, Homo sapiens
RQRNATSSLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSEMV

SEQ ID NO: 854119 - protein, 470 aa, Homo sapiens
RQRNATSSLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDR

SEQ ID NO: 854120 - protein, 435 aa, Homo sapiens
RQRNATSSLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVDALACQSLASAAAGYSVAVKSMEPGARWPGLESWLCHLTATNS

SEQ ID NO: 854121 - protein, 413 aa, Homo sapiens
RQRNATSSLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGEHLPPHLFSRSQGQWLCPGL

SEQ ID NO: 854122 - protein, 126 aa, Homo sapiens
MAPYSLLVTRLQKALGVRQYHVASVLCQRAKVAMSHFEPNEYIHYDLLEKNINIVRKRPDLAHPVAEVGKVAEKEGWPLDIRVDALACQSLASAAAGYSVAVKSMEPGARWPGLESWLCHLTATNS

SEQ ID NO: 854123 - protein, 207 aa, Homo sapiens
MGEGMAPSMFLVSCALSRFASYQHFCARAPTPSRIAVRRENSTAGPALQGWERPHCPWLPESSAGPRPRGPKDRPAALASEEHRGLGRTWKFPGFLSQFWPRLLVGAGDRSGNWCCPTNWPPPFQIVTALAIAGTLKFNPETDYLTGTDGKKFRLEAPDADELPKGVSAHAPCLLVAVWPRHFLLNLTAPPVQAGRALLVRRKQLCS

SEQ ID NO: 854124 - protein, 108 aa, Homo sapiens
MFIVENIHNQEEFLKLLISTPSQEQALRALGEVCCVSVYCVHRFSRFTFYITHAALCDFSCFTHADALACQSLASAAAGYSVAVKSMEPGARWPGLESWLCHLTATNS

SEQ ID NO: 854125 - protein, 673 aa, Homo sapiens; identical to SEQ ID NO: 854106

SEQ ID NO: 854126 - protein, 440 aa, Homo sapiens
RQRNATSSLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGISSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 854127 - protein, 253 aa, Homo sapiens
MRICSEPGVMVNWDLHLRPWASACLAQLLSSSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 854128 - protein, 673 aa, Homo sapiens; identical to SEQ ID NO: 854106

SEQ ID NO: 854129 - protein, 585 aa, Homo sapiens
RQRNATSSLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVTHGVTVVVVGGFLK

SEQ ID NO: 854130 - protein, 103 aa, Homo sapiens
DHHPPDAMFLVERAVSVHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 854131 - protein, 435 aa, Homo sapiens; identical to SEQ ID NO: 854120

SEQ ID NO: 854132 - protein, 201 aa, Homo sapiens
RQRNATSSLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKVSRRWLWGWASGQDWARGLTLTLEQTRALPPNSHTSLDWSAFKT

SEQ ID NO: 854133 - protein, 283 aa, Homo sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKRKVAPELVQTYYERVGHLEDSWGTQASLFDCPLGPPGPCFTPGLGAGTIG

SEQ ID NO: 854134 - protein, 564 aa, Homo sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 854135 - protein, 564 aa, Homo sapiens; identical to SEQ ID NO: 854134

SEQ ID NO: 854136 - protein, 564 aa, Homo sapiens; identical to SEQ ID NO: 854134

SEQ ID NO: 854137 - protein, 593 aa, Homo sapiens
MRTPRLRAQPRGAVYQAPSPPPAPVGLGSMAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 854138 - protein, 269 aa, Homo sapiens
MAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 854139 - protein, 608 aa, Homo sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYVSSSPSFPPAWCPGNAGEVEAEGLSPRHEAEGPSNCGFPFTYPQERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 854140 - protein, 564 aa, Homo sapiens; identical to SEQ ID NO: 854134

SEQ ID NO: 854141 - protein, 345 aa, Homo sapiens
TERVEHLSEFLVEQRKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 854142 - protein, 565 aa, Homo sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEFPRLIRPSTEKFSVGPDWLLELTSDPVVRRNGGLDAHPGSGPEVQAILCRTWPGLVDTGSLPNTLVFGQH

SEQ ID NO: 854143 - protein, 204 aa, Homo sapiens
MDATAHSGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 854144 - protein, 259 aa, Homo sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLLTNGRKPGAGHNNRRVNTGEPRRQHDGRTSPKGCQRRDQHQTKRRNPTGRHTTHHKKGHRRTNQTKQRKTDTNPTSDKQQTQPTPPPLP

SEQ ID NO: 854145 - protein, 165 aa, Homo sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFPRLIRPSTEKFSVGPDWLLELTSDPVVRRNGGLDAHPGSGPEVQAILCRTWPGLVDTGSLPNTLVFGQH

SEQ ID NO: 854146 - protein, 113 aa, Homo sapiens
GSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSE

SEQ ID NO: 854147 - protein, 165 aa, Homo sapiens; identical to SEQ ID NO: 854145

SEQ ID NO: 854148 - protein, 81 aa, Homo sapiens
RHEGTAVIPETEAVRRIVERDGLSEAAAQSRLQSQMSGQQLVEQSHVVLSTLWEPHITQRQVEKAWALLQKRIPKTHQALD

SEQ ID NO: 854149 - protein, 564 aa, Homo sapiens; identical to SEQ ID NO: 854134

SEQ ID NO: 854150 - protein, 564 aa, Homo sapiens; identical to SEQ ID NO: 854134

SEQ ID NO: 854151 - protein, 593 aa, Homo sapiens; identical to SEQ ID NO: 854137

SEQ ID NO: 854152 - protein, 564 aa, Homo sapiens; identical to SEQ ID NO: 854134

SEQ ID NO: 854153 - protein, 425 aa, Homo sapiens
TGVSALQPTSCDMRDCPINVPGFTQIVIWTFSSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 854154 - protein, 636 aa, Homo sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYVSSSPSFPPAWCPGNAGEVEAEGLSPRHEAEGPSNCGFPFTYPQERPELPTCLYVIGLTGISGSGKSSIAQRLKGLGAFVIDSDHLGHRAYAPGGPAYQPVVEAFGTGNNWGRLKVAWSEELARPLCSVVCLCCPDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 854155 - protein, 564 aa, Homo sapiens; identical to SEQ ID NO: 854134

SEQ ID NO: 854156 - protein, 509 aa, Homo sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEPTQHAGIWPTLRMWFMGEQSPPHSCPWVTLTHS

SEQ ID NO: 854157 - protein, 367 aa, Homo sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYVSSSPSFPPAWCPGNAGE

SEQ ID NO: 854158 - protein, 187 aa, Homo sapiens
MWGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 854159 - protein, 108 aa, Homo sapiens
SVPAGEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 854160 - protein, 158 aa, Homo sapiens
RFRLENVTPEGDWQREWMGDGEGHFEGAVGSTMAPEERSGGSGWWEEARRNWFSVCPLSRRRRSLGRKGRMGGQVGCQGLPLTPSFPLFTLSSLPQDLEELALYQIQLLKDLRHTENEEDKVSSSSFRQRMLGNLLRPPYVSSSPSFPPAWCPGNAGE

SEQ ID NO: 854161 - protein, 119 aa, Homo sapiens
MRTEGDSFQVCQWPAKSQYAKLSPPGHRLQPELAPACAAPPTHTSGFRSAHPLVLPFSSAGHRGRSCGLVSLRRQGSHGLQKRSLGWAMTGPGGSRPFFLASPGITRQPFPSLRPYLRM

SEQ ID NO: 854162 - protein, 373 aa, Homo sapiens
MWACHPCLPGSWVGIAPLPDTLIVLRGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGDVKSMAQFYGLLAHVARTRLTPSMAGASVEEDAQLHELAAELQIPDLQLEEALETMAWGRGPVCLLAGGEPTVQLQGSGRGGRNQELALRVGAELRRWPLGPIDVLFLSGGTDGQDGPTEAAGAWVTPELASQAAAEGLDIATFLAHNDSHTFFCCLQGGAHLLHTGMTGTNVMDTHLLFLRPR

SEQ ID NO: 854163 - protein, 373 aa, Homo sapiens; identical to SEQ ID NO: 854162

SEQ ID NO: 854164 - protein, 396 aa, Homo sapiens
MLLKPHSRVQVFEGAEDNLPDRDALRAALAIQQLAEGLTADDLLLVLISGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGDVKSMAQFYGLLAHVARTRLTPSMAGASVEEDAQLHELAAELQIPDLQLEEALETMAWGRGPVCLLAGGEPTVQLQGSGRGGRNQELALRVGAELRRWPLGPIDVLFLSGGTDGQDGPTEAAGAWVTPELASQAAAEGLDIATFLAHNDSHTFFCCLQGGAHLLHTGMTGTNVMDTHLLFLRPR

SEQ ID NO: 854165 - protein, 373 aa, Homo sapiens; identical to SEQ ID NO: 854162

SEQ ID NO: 854166 - protein, 283 aa, Homo sapiens
MELLLSQSCIWWPMVGEGRTIISCGIKAMERSGNYLIWLQKGEMLLKPHSRVQVFEGAEDNLPDRDALRAALAIQQLAEGLTADDLLLVLISGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGWGTPAAHRDDRYQCHGHPPLVPAASVMA

SEQ ID NO: 854167 - protein, 205 aa, Homo sapiens
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISGWGTPAAHRDDRYQCHGHPPLVPAASVMA

SEQ ID NO: 854168 - protein, 523 aa, Homo sapiens
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGDVKSMAQFYGLLAHVARTRLTPSMAGASVEEDAQLHELAAELQIPDLQLEEALETMAWGRGPVCLLAGGEPTVQLQGSGRGGRNQELALRVGAELRRWPLGPIDVLFLSGGTDGQDGPTEAAGAWVTPELASQAAAEGLDIATFLAHNDSHTFFCCLQGGAHLLHTGMTGTNVMDTHLLFLRPR

SEQ ID NO: 854169 - protein, 192 aa, Homo sapiens
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISGVVPHWPKTVGGGCTT

SEQ ID NO: 854170 - protein, 457 aa, Homo sapiens
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGDVKSMAQFYGLLAHVARTRLTPSMAGASVEEDAQLHELAAELQIPDLQLEEALETMAWGRGPVCLLAGGEPTVQLQGSGRGGRNQELALRVGAELRRWPLGPIDVLFLSGGTDGQDGPTEAAGAWVTPELASQAAAEGLDIATFLAHNDSHTFFCCLQGGAHLLHTGMTGTNVMDTHLLFLRPR

SEQ ID NO: 854171 - protein, 94 aa, Homo sapiens
RPRATPGTPEAPRTHLHKAVGVREAWQHHLSVGFGCAGRRQDPGLPGKLLKKASSSNCASSLQYPLNSSKQTLFPADIAGTILVNTEWELSTHL

SEQ ID NO: 854172 - protein, 102 aa, Homo sapiens
GGRGRLLVPPRPRELTFTKLSASGKPGSTISPSDLVALVADRTLGSRVLGGAIFSACTARLARACRPRRRDACAPRMRQVEAAGGASDYSVGSLRLGWGACD

SEQ ID NO: 854173 - protein, 102 aa, Homo sapiens; identical to SEQ ID NO: 854172

SEQ ID NO: 854174 - protein, 126 aa, Homo sapiens
RPRATPGTPEAPRTHLHKAVGVREAWQHHLSVGFGCAGRRQDPGLPGTGWRHFFSLHGSSRESLSAEETGRVRTTHAPGKLLKKASSSNCASSLQYPLNSSKQTLFPADIAGTILVNTEWELSTHL

SEQ ID NO: 854175 - protein, 1669 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 854176 - protein, 1605 aa, Homo sapiens
MQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 854177 - protein, 1649 aa, Homo sapiens
MQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGEVIFELLPGSIMKTWASPYSFYDSAFTVSIQSKKMFTAFPLATGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 854178 - protein, 577 aa, Homo sapiens
AGWVRNSRDPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 854179 - protein, 1669 aa, Homo sapiens; identical to SEQ ID NO: 854175

SEQ ID NO: 854180 - protein, 458 aa, Homo sapiens [sequence omitted]

SEQ ID NO: 854181 - protein, 1651 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 854182 - protein, 372 aa, Homo sapiens
FLNDPRRGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 854183 - protein, 1681 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMKCAIHRVSRPWDLQLLRKRLQLLARHHREERDVQEAYAVHLEGRGAAHARQPLPSLYEKNIMKPDSANVTTWCYFFFFLLTATNPRNISCVPHCPI

SEQ ID NO: 854184 - protein, 431 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEEDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 854185 - protein, 1669 aa, Homo sapiens; identical to SEQ ID NO: 854175

SEQ ID NO: 854186 - protein, 1669 aa, Homo sapiens; identical to SEQ ID NO: 854175

SEQ ID NO: 854187 - protein, 1669 aa, Homo sapiens; identical to SEQ ID NO: 854175

SEQ ID NO: 854188 - protein, 1669 aa, Homo sapiens; identical to SEQ ID NO: 854175

SEQ ID NO: 854189 - protein, 270 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDIDNHVPSHRSCCHSAACTEETESFSYSNKSIRVLKKK

SEQ ID NO: 854190 - protein, 1669 aa, Homo sapiens; identical to SEQ ID NO: 854175

SEQ ID NO: 854191 - protein, 1297 aa, Homo sapiens
MFLLWKGLCSGSLKLVSVDVLAAVLGRDISLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 854192 - protein, 670 aa, Homo sapiens
APLYGGEAKKYTVSVVIAGPTARDTDEWRTSKLPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 854193 - protein, 129 aa, Homo sapiens
CLCSTSRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 854194 - protein, 1669 aa, Homo sapiens; identical to SEQ ID NO: 854175

SEQ ID NO: 854195 - protein, 1669 aa, Homo sapiens; identical to SEQ ID NO: 854175

SEQ ID NO: 854196 - protein, 294 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRRRRADSDH

SEQ ID NO: 854197 - protein, 87 aa, Homo sapiens
CQDQVEEMGSRVLLVPLGPLGSLATQVSSLRNGLMWGASRHQGAGQTQVGGCDSPPQPECNRKAWILLIIHIPLRESSENEPCYKKQ

SEQ ID NO: 854198 - protein, 777 aa, Homo sapiens
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 854199 - protein, 771 aa, Homo sapiens
MLPRPLRLLLDTSPPGGVVLSSFRSRDPEEGGGPGGLVVGGGQEEEEEEEEECFVDYFFFFFFFFYIYFFLIPWVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 854200 - protein, 695 aa, Homo sapiens
MPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 854201 - protein, 695 aa, Homo sapiens; identical to SEQ ID NO: 854200

SEQ ID NO: 854202 - protein, 532 aa, Homo sapiens
MNFNLLTSTLQELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 854203 - protein, 803 aa, Homo sapiens
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEERFTGWGVVSWDFHFSLILPISCHCRVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 854204 - protein, 816 aa, Homo sapiens
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKVSGVSGLDAGLPYPCSRKGRGKSQGSLSFGSCSLRAPSQEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 854205 - protein, 783 aa, Homo sapiens
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKFEGSSQEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 854206 - protein, 777 aa, Homo sapiens; identical to SEQ ID NO: 854198

SEQ ID NO: 854207 - protein, 803 aa, Homo sapiens; identical to SEQ ID NO: 854203

SEQ ID NO: 854208 - protein, 697 aa, Homo sapiens
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNREADYPSLG

SEQ ID NO: 854209 - protein, 777 aa, Homo sapiens; identical to SEQ ID NO: 854198

SEQ ID NO: 854210 - protein, 337 aa, Homo sapiens
MLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 854211 - protein, 720 aa, Homo sapiens
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVREPWDGVGVKDGVLLDYKCCLRFGQPNGIECSFNFDLWFWQLCFIFNFIF

SEQ ID NO: 854212 - protein, 273 aa, Homo sapiens
MSRGAGVVGASSPPVLGRSQDTSGVGTPTEPKTSVHCEMTNVGRSTHRAGFLSCLVNQWHFTAPGWLAHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 854213 - protein, 777 aa, Homo sapiens; identical to SEQ ID NO: 854198

SEQ ID NO: 854214 - protein, 778 aa, Homo sapiens
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTMKCHWFTRQLRNPALWELVSYNQVGYLCIASHLP

SEQ ID NO: 854215 - protein, 778 aa, Homo sapiens; identical to SEQ ID NO: 854214

SEQ ID NO: 854216 - protein, 447 aa, Homo sapiens
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQSADHRAAWDSQQANPHHLRAHLAADRHGGSVQVVSSTNGELNTDDPTAGRSNAPITAPTEVEVMDETKCCCFFKRRKRKTIQRHK

SEQ ID NO: 854217 - protein, 447 aa, Homo sapiens; identical to SEQ ID NO: 854216

SEQ ID NO: 854218 - protein, 455 aa, Homo sapiens
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQSADHRAAWDSQQANPHHLRAHLAADRHGGSVQVVSSTNGELNTDDPTAGRSNAPITAPTEVEVMDETNCQKVLNMWCCCFFKRRKRKTIQRHK

SEQ ID NO: 854219 - protein, 415 aa, Homo sapiens
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETKCCCFFKRRKRKTIQRHK

SEQ ID NO: 854220 - protein, 302 aa, Homo sapiens
MVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETKCCCFFKRRKRKTIQRHK

SEQ ID NO: 854221 - protein, 415 aa, Homo sapiens; identical to SEQ ID NO: 854219

SEQ ID NO: 854222 - protein, 415 aa, Homo sapiens; identical to SEQ ID NO: 854219

SEQ ID NO: 854223 - protein, 447 aa, Homo sapiens; identical to SEQ ID NO: 854216

SEQ ID NO: 854224 - protein, 447 aa, Homo sapiens; identical to SEQ ID NO: 854216

SEQ ID NO: 854225 - protein, 447 aa, Homo sapiens; identical to SEQ ID NO: 854216

SEQ ID NO: 854226 - protein, 415 aa, Homo sapiens; identical to SEQ ID NO: 854219

SEQ ID NO: 854227 - protein, 415 aa, Homo sapiens; identical to SEQ ID NO: 854219

SEQ ID NO: 854228 - protein, 423 aa, Homo sapiens
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETNCQKVLNMWCCCFFKRRKRKTIQRHK

SEQ ID NO: 854229 - protein, 133 aa, Homo sapiens
MATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETKCCCFFKRRKRKTIQRHK

SEQ ID NO: 854230 - protein, 415 aa, Homo sapiens; identical to SEQ ID NO: 854219

SEQ ID NO: 854231 - protein, 415 aa, Homo sapiens; identical to SEQ ID NO: 854219

SEQ ID NO: 854232 - protein, 870 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 854233 - protein, 496 aa, Homo sapiens
HGVTVRTRIAVLSLRPPVWWNVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 854234 - protein, 870 aa, Homo sapiens; identical to SEQ ID NO: 854232

SEQ ID NO: 854235 - protein, 866 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRYFVLLLKPKQSWAILAHPSVSSL

SEQ ID NO: 854236 - protein, 870 aa, Homo sapiens; identical to SEQ ID NO: 854232

SEQ ID NO: 854237 - protein, 833 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGR

SEQ ID NO: 854238 - protein, 807 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHAPAPTITRTGAGGPVRVIACTSANNNTYWSSNSTTLAAAR

SEQ ID NO: 854239 - protein, 434 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGLLTQERHDSSPPARGSL

SEQ ID NO: 854240 - protein, 402 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVRADRSARDRPDLQRQQDRYGTSQSFLRFARAGIVHRSFEVLH

SEQ ID NO: 854241 - protein, 205 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKVSCNLSSLGVAVWPSS

SEQ ID NO: 854242 - protein, 205 aa, Homo sapiens; identical to SEQ ID NO: 854241

SEQ ID NO: 854243 - protein, 733 aa, Homo sapiens
MGPPSLVLCLLSATVFSLLGGSSAFLSHHRLKGRFQRDRRNIRPNIILVLTDDQDVELAFFGKYLNEYNGSYVPPGWKEWVGLLKNSRFYNYTLCRNGVKEKHGSDYSKHAELQLRAQPGQTLDHALHGAHEAIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 854244 - protein, 399 aa, Homo sapiens
PWNRSYENRCPLLAAASVVDVNAKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 854245 - protein, 852 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRGQLWEGWEG

SEQ ID NO: 854246 - protein, 870 aa, Homo sapiens; identical to SEQ ID NO: 854232

SEQ ID NO: 854247 - protein, 202 aa, Homo sapiens
LLLVLWLFFFAGFAVCLFLCCWFCLFGCCLSRLFLSRLLFGLRACGWAVLSALLSFVLLSLCRSVSVARCLFGSLSLLCCCGCCVVCVFLSCSLVPLVFVSACVLLSFLFLCCFSVGCCVVSALSFAVLSLCSLFALFLLLLSSSLGVSGFCLFLFVFALCVLVCVVLCVFLLFLPVWRGGCLIFLVSRGVLLLWVPPPLGL

SEQ ID NO: 854248 - protein, 686 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFR

SEQ ID NO: 854249 - protein, 151 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTGPEPIKKSDPRVS

SEQ ID NO: 854250 - protein, 668 aa, Homo sapiens
MTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGPGAARDSQAEPTQPEQAAEAPAEGGPQTNQLETGASSPERSNEVEMDSTVITVSNSSDKSVLQQPSVNTSIGQPLPSTQLYLRQTETLTSNLRMPLTLTSNTQVIGTAGNTYLPALFTTQPAGSGPKPFLFSLPQPLAGQQTQFVTVSQPGLSTFTAQLPAPQPLASSAGHSTASGQGEKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPAKFDQIEQFNDHMRMHVSDG

SEQ ID NO: 854251 - protein, 741 aa, Homo sapiens
MLERKKPKTAENQKASEENEITQPGGSSAKPGLPCLNFEAVLSPDPALIHSTHSLTNSHAHTGSSDCDISCKGMTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGPGAARDSQAEPTQPEQAAEAPAEGGPQTNQLETGASSPERSNEVEMDSTVITVSNSSDKSVLQQPSVNTSIGQPLPSTQLYLRQTETLTSNLRMPLTLTSNTQVIGTAGNTYLPALFTTQPAGSGPKPFLFSLPQPLAGQQTQFVTVSQPGLSTFTAQLPAPQPLASSAGHSTASGQGEKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPAKFDQIEQFNDHMRMHVSDG

SEQ ID NO: 854252 - protein, 741 aa, Homo sapiens; identical to SEQ ID NO: 854251

SEQ ID NO: 854253 - protein, 668 aa, Homo sapiens; identical to SEQ ID NO: 854250

SEQ ID NO: 854254 - protein, 772 aa, Homo sapiens
MLERKKPKTAENQKASEENEITQPGGSSAKPGLPCLNFEAVLSPDPALIHSTHSLTNSHAHTGSSDCDISCKGMTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGPGAARDSQAEPTQPEQAAEAPAEGGPQTNQLETGASSPERSNEVEMDSTVITVSNSSDKSVLQQPSVNTSIGQPLPSTQLYLRQTETLTSNLRMPLTLTSNTQVIGTAGNTYLPALFTTQPAGSGPKPFLFSLPQPLAGQQTQFVTVSQPGLSTFTAQLPAPQPLASSAGHSTASGQGEKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPLRVSRTLLYSFGPIQPSSYVSSSIAIGLAINNTFGVILHCGICSYSLISAS

SEQ ID NO: 854255 - protein, 741 aa, Homo sapiens; identical to SEQ ID NO: 854251

SEQ ID NO: 854256 - protein, 741 aa, Homo sapiens; identical to SEQ ID NO: 854251

SEQ ID NO: 854257 - protein, 741 aa, Homo sapiens; identical to SEQ ID NO: 854251

SEQ ID NO: 854258 - protein, 741 aa, Homo sapiens; identical to SEQ ID NO: 854251

SEQ ID NO: 854259 - protein, 737 aa, Homo sapiens
MLERKKPKTAENQKASEENEITQPGGSSAKPGLPCLNFEAVLSPDPALIHSTHSLTNSHAHTGSSDCDISCKGMTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGPGAARDSQAEPTQPEQAAEAPAEGGPQTNQLETGASSPERSNEVEMDSTVITVSNSSDKSVLQQPSVNTSIGQPLPSTQLYLRQTETLTSNLRMPLTLTSNTQVIGTAGNTYLPALFTTQPAGSGPKPFLFSLPQPLAGQQTQFVTVSQPGLSTFTAQLPAPQPLASSAGHSTASGQGEKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPAKFDQIEQFNDHMRMH

SEQ ID NO: 854260 - protein, 130 aa, Homo sapiens
ERSHSRRATLEHPALVPLQPAEMVELMFPLLLLLLPFLLYMAAPQIRSVQMYCLLLRILVAGREGNIESPPKLSWKTPLGGLQDGGAQSSVGWRRGPAVLGARRTPETPGGEKGRQSGAHCFSLACFSFV

SEQ ID NO: 854261 - protein, 340 aa, Homo sapiens
ERSHSRRATLEHPALVPLQPAEMVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 854262 - protein, 340 aa, Homo sapiens; identical to SEQ ID NO: 854261

SEQ ID NO: 854263 - protein, 318 aa, Homo sapiens
MVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 854264 - protein, 327 aa, Homo sapiens
ERSHSRRATLEHPALVPLQPAEMVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKVQSELVRHSSFMRWMWWLFSFFIKTPQQGAQTSLHCALTEGLEILSGNHFSDCHVAWVSAQARNETIARRLWDVSCDLLGLPID

SEQ ID NO: 854265 - protein, 282 aa, Homo sapiens
MVGSLDLSNQVSENGSIRTIQKLGLHEQGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 854266 - protein, 178 aa, Homo sapiens
EVRLGTRLGGVRHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 854267 - protein, 340 aa, Homo sapiens; identical to SEQ ID NO: 854261

SEQ ID NO: 854268 - protein, 195 aa, Homo sapiens
ERSHSRRATLEHPALVPLQPAEMVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFHEMDVVAFLLFHQDSSAGSPDQPALCLNRRS

SEQ ID NO: 854269 - protein, 340 aa, Homo sapiens; identical to SEQ ID NO: 854261

SEQ ID NO: 854270 - protein, 136 aa, Homo sapiens
ERSHSRRATLEHPALVPLQPAEMVELMFPLLLLLLPFLLYMAAPQIRKMLSSGVCTSTVQLPGKVVVVTGANTGIGKETAKELAQRGARVYLACRDVEKGELVAKEIQTTTGNQQVLVPVGPKRRLQQTTQYFLSK

SEQ ID NO: 854271 - protein, 72 aa, Homo sapiens
EVRLGTRLGGVPAEMVELMFPLLLLLLPFLLYMAAPQISDCHVAWVSAQARNETIARRLWDVSCDLLGLPID

SEQ ID NO: 854272 - protein, 340 aa, Homo sapiens; identical to SEQ ID NO: 854261

SEQ ID NO: 854273 - protein, 325 aa, Homo sapiens
ERSHSRRATLEHPALVPLQPAEMVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSWQRWRRSYVMHPCLSETP

SEQ ID NO: 854274 - protein, 323 aa, Homo sapiens
ERSHSRRATLEHPALVPLQPAEMVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSPVFFILFWIPNSIVLH

SEQ ID NO: 854275 - protein, 340 aa, Homo sapiens; identical to SEQ ID NO: 854261

SEQ ID NO: 854276 - protein, 102 aa, Homo sapiens
MQGTKRSEEERRRRSRRQRTSGRRQGAHATAPQGGTQQRKETERARRGREQEKERRRRRREEKKQRPKEANKQKQGKERTNKAQETQTAGEGKSHEGTHANT

SEQ ID NO: 854277 - protein, 340 aa, Homo sapiens; identical to SEQ ID NO: 854261

SEQ ID NO: 854278 - protein, 122 aa, Homo sapiens
ERSHSRRATLEHPALVPLQPAEMVELMFPLLLLLLPFLLYMAAPQIRKMLSSGVCTSTVQLPGKVVVVTGANTGIGKETAKELAQRGKFTSFQFPPITAVLPLTVMMIHSHCFFPVLEFKNT

SEQ ID NO: 854279 - protein, 188 aa, Homo sapiens
MMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 854280 - protein, 213 aa, Homo sapiens
REAIVGEQRWSIPLWCRCSRQRWLSSCSRCCSSFCPSFCIWLRPKSGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 854281 - protein, 133 aa, Homo sapiens
EVRLGTRLGGYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 854282 - protein, 340 aa, Homo sapiens; identical to SEQ ID NO: 854261

SEQ ID NO: 854283 - protein, 340 aa, Homo sapiens; identical to SEQ ID NO: 854261

SEQ ID NO: 854284 - protein, 133 aa, Homo sapiens; identical to SEQ ID NO: 854281

SEQ ID NO: 854285 - protein, 148 aa, Homo sapiens
ERSHSRRATLEHPALVPLQPAEMVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAAQSSLLILVN

SEQ ID NO: 854286 - protein, 1265 aa, Homo sapiens
MERLLAQLCGSSAAWPLPLWEGDTTGHCFTQLVLSALPHALLAVLSACYLGTPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGAWSSRTWCWRTGQGCRMPWME

SEQ ID NO: 854287 - protein, 182 aa, Homo sapiens
DSPLLTTQHPSVPTAQSCPQWLLRHPFLPHRVCDHCWCKFPLHPSPGSALCSRHPSSSCHSASPPAASSPYGLVGLSLSYALSLTGLLSGLVSSFTQTEAMLVSVERLEEYTCDLPQEPQGQPLQVGLYPHPRPKLWNPEGPSLPHNSFLFAHPSFSAPITSLHDDHNSSPCPFFPISHSLI

SEQ ID NO: 854288 - protein, 371 aa, Homo sapiens
MQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGAWSSRTWCWRTGQGCRMPWME

SEQ ID NO: 854289 - protein, 1468 aa, Homo sapiens
MERLLAQLCGSSAAWPLPLWEGDTTGHCFTQLVLSALPHALLAVLSACYLGTPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHRYPTSYAPLSLLCPLANTEPLLCVGHLLGVRGTKKSNAWSLYWESFQSGKKEVAKKGIIVIITPECFKCYNSQQRNGNIQCQLFFQKCGCAEKGSREEHRFEGGPVFSDGNKYNVVAILSTELLNRCKYNSCLAVAKELFLPFFAQNGLHEDPLTSGAAISVMCHEGGPCVEDSSLGRLLGVKGWAWRDPEEAGPHIARLALCRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGAWSSRTWCWRTGQGCRMPWME

SEQ ID NO: 854290 - protein, 1422 aa, Homo sapiens
MERLLAQLCGSSAAWPLPLWEGDTTGHCFTQLVLSALPHALLAVLSACYLGTPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHRYPTSYAPLSLLCPLANTEPLLCVGHLLGVRGTKKSNAWSLYWESFQSGKKEVAKKGIIVIITPECFKCYNSQQRNGNIQCQLFFQKCGCAEKGSREEHRFEGGPVFSDGNKYNVVAILSTELLNRCKYNSCLAVAKELFLPFFAQNGLHEDPLTSGAAISVMCHEGGPCVEDSSLGRLLGVKGWAWRDPEEAGPHIARLALCRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGATQDPSPLPHPQVSPPLSQISPCTIPPTFSPPTQGSL

SEQ ID NO: 854291 - protein, 58 aa, Homo sapiens
MQWLDIRLQLMGAAVVSAIAGIALVQHQQGLANPGATQDPSPLPHPQVSPPLSQISPC

SEQ ID NO: 854292 - protein, 139 aa, Homo sapiens
MPAVHSLGSLPQTSRCPSSPSSWYFSPPGLVGLSLSYALSLTGLLSGLVSSFTQTEAMLVSVERLEEYTCDLPQEPQGQPLQVGLYPHPRPKLWNPEGPSLPHNSFLFAHPSFSAPITSLHDDHNSSPCPFFPISHSLI

SEQ ID NO: 854293 - protein, 652 aa, Homo sapiens
MERLLAQLCGSSAAWPLPLWEGDTTGHCFTQLVLSALPHALLAVLSACYLGTPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHR

SEQ ID NO: 854294 - protein, 1468 aa, Homo sapiens; identical to SEQ ID NO: 854289

SEQ ID NO: 854295 - protein, 652 aa, Homo sapiens; identical to SEQ ID NO: 854293

SEQ ID NO: 854296 - protein, 192 aa, Homo sapiens
AYTSSQDIGIRCTAASSGLRFRMPGGGETGGEKQMARWVTSVQKSTGETSSRFYPWYRENGRGLASGRKRRAVPVPGGAGDRETRLGSAGKAGCYPAQPSPSTFPSGEASMERLLAQLCGSSAAWPLPLWEGDTTGHCFTQLVLSALPHALLAVLSACYLGTPRWVETGARHLSMCACRSHPRPTSSGSVTR

SEQ ID NO: 854297 - protein, 124 aa, Homo sapiens
TKNKQRVCLGDGPASSLQSLPSQAKERELGPLSLYPTRAWAPSPLPPRTWASLGGNLDTWMLEPRSEVLLSHGTVTRTVPSIPVQTGRGHPLSLALLCDLAGVMSHSRDRGIGAGLFRVMAPRR

SEQ ID NO: 854298 - protein, 75 aa, Homo sapiens
AHVAPASRQSAGLQGLRRLRESLTGTLTGGWRTGDSDLRQRVLLRHPGWSAMALSRLTATSASRIQAILLPQPPE

SEQ ID NO: 854299 - protein, 370 aa, Homo sapiens
CPRCAGLAPVRWAAGTAAPEGVADGHADWRLADRRQRPAAGPEEREQQEPHPAAMSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 854300 - protein, 316 aa, Homo sapiens
MSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 854301 - protein, 316 aa, Homo sapiens; identical to SEQ ID NO: 854300

SEQ ID NO: 854302 - protein, 287 aa, Homo sapiens
MADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 854303 - protein, 228 aa, Homo sapiens
SSPKGYMNIVVGKRLIIKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 854304 - protein, 337 aa, Homo sapiens
CPRCAGLAPVRWAAGTAAPEGVADGHADWRLADRRQRPAAGPEEREQQEPHPAAMSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTLEDGFPVHDGKGDMRKCPFYAAEQDKGALEGSSCPFRTAMAVLRKPSLQFILAAGVALAAGLLAWYYM

SEQ ID NO: 854305 - protein, 111 aa, Homo sapiens
MRSVGNNVLNYTFFPFSIMGRMQENLCHRVTVYTCGSRGCPLALEDGFPVHDGKGDMRKCPFYAAEQDKGALEGSSCPFRTAMAVLRKPSLQFILAAGVALAAGLLAWYYM

SEQ ID NO: 854306 - protein, 165 aa, Homo sapiens
CPRCAGLAPVRWAAGTAAPEGVADGHADWRLADRRQRPAAGPEEREQQEPHPAAMSAEVETSEGVDESEKKNSGALEKENQMRMADLSELLKEGTKEAHDRAENTQFVKDFLKGNIKKELFKVCAPHWVPDCHMGLGWGPWSHEKSAPGATLREKLGFSPHSIPS

SEQ ID NO: 854307 - protein, 370 aa, Homo sapiens; identical to SEQ ID NO: 854299

SEQ ID NO: 854308 - protein, 389 aa, Homo sapiens
AVRGRVLMAEGRTGDSDLRQSLAATPRLECNGAISAHCNLRFPDSSDSPASASRVGGTTGPEEREQQEPHPAAMSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 854309 - protein, 410 aa, Homo sapiens
CPRCAGLAPVRWAAGTAAPEGVADGHADWRLADRRQRPAAESLAATPRLECNGAISAHCNLRFPDSSDSPASASRVGGTTGPEEREQQEPHPAAMSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 854310 - protein, 343 aa, Homo sapiens
AREGTRRTAWLSSGALCRMKHYSSRDCLTAQLETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 854311 - protein, 337 aa, Homo sapiens; identical to SEQ ID NO: 854304

SEQ ID NO: 854312 - protein, 271 aa, Homo sapiens
CPRCAGLAPVRWAAGTAAPEGVADGHADWRLADRRQRPAAGPEEREQQEPHPAAMSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 854313 - protein, 70 aa, Homo sapiens
RARYRSLKEIPIPSDPLFHCLSVSWTHPGLVFALRRSLALGLPFPGTLGLIPFSSSGDFLKNAGFKKGNQ

SEQ ID NO: 854314 - protein, 301 aa, Homo sapiens
NKMQSPSPNDPARNLGSADPERTETAVLLLYRGGGMARVVREGALLHQQEIGAVLGLELPARSFARAHPDPSSRGGCFRPAAVGLTQRPARAFHALAFPLADFLFSEVAGFVLFSGSGAFPNLRMPVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKASRHLDSYEFLKAILN

SEQ ID NO: 854315 - protein, 340 aa, Homo sapiens
NKMQSPSPNDPARNLGSADPERTETAVLLLYRGGGMARVVREGALLHQQEIGAVLGLELPARSFARAHPDPSSRGGCFRPAAVGLTQRPARAFHALAFPLADFLFSEVAGFVLFSGSGAFPNLRMPFAPVAQAGVQWHDFRSLQHLLPAFKRFSCLSLGSSWDYSVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKASRHLDSYEFLKAILN

SEQ ID NO: 854316 - protein, 294 aa, Homo sapiens
NKMQSPSPNDPARNLGSADPERTETAVLLLYRGGGMARVVREGALLHQQEIGAVLGLELPARSFARAHPDPSSRGGCFRPAAVGLTQRPARAFHALAFPLADFLFSEVAGFVLFSGSGAFPNLRMPVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKGQPQMSQPL

SEQ ID NO: 854317 - protein, 148 aa, Homo sapiens
NKMQSPSPNDPARNLGSADPERTETAVLLLYRGGGMARVVREGALLHQQEIGAVLGLELPARSFARAHPDPSSRGGCFRPAAVGLTQRPARAFHALAFPLADFLFSEVAGFVLFSGSGAFPNLRMPVKRSLKLDGLLEENIHDVAIKS

SEQ ID NO: 854318 - protein, 145 aa, Homo sapiens
NKMQSPSPNDPARNLGSADPERTETAVLLLYRGGGMARVVREGALLHQQEIGAVLGLELPARSFARAHPDPSSRGGCFRPAAVGLTQRPARAFHALAFPLADFLFSEVAGFVLFSGSGAFPNLRMPVKRSLKLDGLLEENKREKN

SEQ ID NO: 854319 - protein, 137 aa, Homo sapiens
MSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKASRHLDSYEFLKAILN

SEQ ID NO: 854320 - protein, 148 aa, Homo sapiens; identical to SEQ ID NO: 854317

SEQ ID NO: 854321 - protein, 103 aa, Homo sapiens
HTPCEHRQPKARMNSCFIVEKLSEEIMEIMQNLSSIQALEGSRELENLIGISCASHFLKREMQKTKELMTKVNKQKLFEKSTGLPHKASRHLDSYEFLKAILN

SEQ ID NO: 854322 - protein, 145 aa, Homo sapiens; identical to SEQ ID NO: 854318

SEQ ID NO: 854323 - protein, 297 aa, Homo sapiens
NKMQSPSPNDPARNLGSADPERTETAVLLLYRGGGMARVVREGALLHQQEIGAVLGLELPARSFARAHPDPSSRGGCFRPAAVGLTQRPARAFHALAFPLADFLFSEVAGFVLFSGSGAFPNLRMPVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKDTSILKALRFEV

SEQ ID NO: 854324 - protein, 74 aa, Homo sapiens
DASDELDGLLHVEPAVPAHHQRGLLPLRRLHGGDDTLDEVLRVVGAALEHLHPLPQPARARLLVLFYFGCRQKP

SEQ ID NO: 854325 - protein, 287 aa, Homo sapiens
NKMQSPSPNDPARNLGSADPERTETAVLLLYRGGGMARVVREGALLHQQEIGAVLGLELPARSFARAHPDPSIAGRMFPPGRGGLDATSSARFSCLGVSFGGFSVFGSCWVRFIQRQWCFPESQNASFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKASRHLDSYEFLKAILN

SEQ ID NO: 854326 - protein, 197 aa, Homo sapiens
MAGCEGRGRLSAAGCFPGISECLLKITEVDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKASRHLDSYEFLKAILN

SEQ ID NO: 854327 - protein, 301 aa, Homo sapiens; identical to SEQ ID NO: 854314

SEQ ID NO: 854328 - protein, 340 aa, Homo sapiens; identical to SEQ ID NO: 854315

SEQ ID NO: 854329 - protein, 287 aa, Homo sapiens
NKMQSPSPNDPARNLGSADPERTETAVLLLYRGGGMARVVREGALLHQQEIGAVLGLELPARSFARAHPDPSSRGGCFRPAAVGLTQRPARAFHALAFPLADFLFSEVAGFVLFSGSGAFPNLRMPVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKGK

SEQ ID NO: 854330 - protein, 205 aa, Homo sapiens
DHSSSRASTRPGRFWILAVEGVCLPLQRKMVMRPLWSLLLWEDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLVVVPVSLLLMLVTLFSAWHWCPCSGKKKKDVHADRVGPETENPLVQDLP

SEQ ID NO: 854331 - protein, 205 aa, Homo sapiens; identical to SEQ ID NO: 854330

SEQ ID NO: 854332 - protein, 205 aa, Homo sapiens; identical to SEQ ID NO: 854330

SEQ ID NO: 854333 - protein, 314 aa, Homo sapiens
DHSSSRASTRPGRFWILAVEGVCLPLQRKMVMRPLWSLLLWEALLPITVTGAQVLSKVGGSVLLVAARPPGFQVREAIWRSLWPSEELLATFFRGSLETLYHSRFLGRAQLHSNLSLELGPLESGDSGNFSVLMVDTRGQPWTQTLQLKVYDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLVVVPVSLLLMLVTLFSAWHWCPCSGKKKKDVHADRVGPETENPLVQDLP

SEQ ID NO: 854334 - protein, 205 aa, Homo sapiens; identical to SEQ ID NO: 854330

SEQ ID NO: 854335 - protein, 134 aa, Homo sapiens
GRGGKRDTGKGGEKGGGGKGEKRPGEEEENQGTEKSARPPGQAEEEQPGQPSHHEDRKHQHVSHLPLPSPIFSYPGSSLGKMSQAEHSIQDTGSSPGSRSMGTLIVQGIPSPTTIHKVLTNWHQGIASSLSPRL

SEQ ID NO: 854336 - protein, 205 aa, Homo sapiens; identical to SEQ ID NO: 854330

SEQ ID NO: 854337 - protein, 313 aa, Homo sapiens
DHSSSRASTRPGRFWILAVEGVCLPLQRKMVMRPLWSLLLWEALLPITVTGAQVLSKVGGSVLLVAARPPGFQVREAIWRSLWPSEELLATFFRGSLETLYHSRFLGRAQLHSNLSLELGPLESGDSGNFSVLMVDTRGQPWTQTLQLKVYDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLGGGACLAAPDAGYSLLCLALVPLLRAPPQIKAALDEMGPAALPPQGDS

SEQ ID NO: 854338 - protein, 233 aa, Homo sapiens
WLVRGSVNRRVCHRSTWPASVPPRHFHLACLRPAAPLRLPPSPARRAMPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRG

SEQ ID NO: 854339 - protein, 362 aa, Homo sapiens
RGTAAGKGARKGSCHRATWPASVPPRHFHLACLRPAAPLRLPPSPARRAMPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 854340 - protein, 349 aa, Homo sapiens
KKNKARTRLVELDKVDLACLRPAAPLRLPPSPARRAMPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 854341 - protein, 165 aa, Homo sapiens
MESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 854342 - protein, 362 aa, Homo sapiens; identical to SEQ ID NO: 854339

SEQ ID NO: 854343 - protein, 325 aa, Homo sapiens
RGTAAGKGARKGSCHRATWPASVPPRHFHLACLRPAAPLRLPPSPARRAMPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKVGCLGKGDLPAYHTELFSSLIWENKLQSLVSD

SEQ ID NO: 854344 - protein, 263 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKVGCLGKGDLPAYHTELFSS

SEQ ID NO: 854345 - protein, 337 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMAGQLTVHHIELAEGWQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 854346 - protein, 263 aa, Homo sapiens; identical to SEQ ID NO: 854344

SEQ ID NO: 854347 - protein, 263 aa, Homo sapiens; identical to SEQ ID NO: 854344

SEQ ID NO: 854348 - protein, 159 aa, Homo sapiens
MSWLLFLSCFTLPLAVVFQTTIPPYLPLLVPHLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 854349 - protein, 159 aa, Homo sapiens; identical to SEQ ID NO: 854348

SEQ ID NO: 854350 - protein, 246 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNNSAQYRPLGLTVTWNLAGQP

SEQ ID NO: 854351 - protein, 109 aa, Homo sapiens
MSWLLFLSCFTLPLAVVFQTTIPPYLPLLVPHLPLMALPPCHALCQFYVVNSELSCQLYQRSGDMGLGVPFNIASYALLTYMIAHITGLKVGCLGKGDLPAYHTELFSS

SEQ ID NO: 854352 - protein, 235 aa, Homo sapiens
RGTAAGKGARKGSCHRATWPASVPPRHFHLACLRPAAPLRLPPSPARRAMPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRG

SEQ ID NO: 854353 - protein, 313 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 854354 - protein, 352 aa, Homo sapiens
RDGRGKRRAEGVLPPRHLDLACLRPAAPLRLPPSPARRAMPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 854355 - protein, 160 aa, Homo sapiens
ELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 854356 - protein, 313 aa, Homo sapiens; identical to SEQ ID NO: 854353

SEQ ID NO: 854357 - protein, 313 aa, Homo sapiens; identical to SEQ ID NO: 854353

SEQ ID NO: 854358 - protein, 362 aa, Homo sapiens; identical to SEQ ID NO: 854339

SEQ ID NO: 854359 - protein, 238 aa, Homo sapiens
QKKQNGKNNRLVQLLIGRGGLMMYELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 854360 - protein, 203 aa, Homo sapiens
GPTKTWSSTSRSRAEAGSRDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 854361 - protein, 331 aa, Homo sapiens
RGTAAGKGARKGSCHRATWPASVPPRHFHLACLRPAAPLRLPPSPARRAMPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQVRIRCYTFGFGTFS

SEQ ID NO: 854362 - protein, 325 aa, Homo sapiens; identical to SEQ ID NO: 854343

SEQ ID NO: 854363 - protein, 325 aa, Homo sapiens; identical to SEQ ID NO: 854343

SEQ ID NO: 854364 - protein, 277 aa, Homo sapiens
ETVWQIVFHEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMAGQLTVHHIELAEGWQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 854365 - protein, 85 aa, Homo sapiens
LALTGRLALSILCHRQIAAWLVFVLGNGKFIGGTRDKMPPLLCCGFNLPFEAEPQRAVGGAAVKRSARVTLHSQLLMRHQAPDAV

SEQ ID NO: 854366 - protein, 521 aa, Homo sapiens
LLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDLQDEDVATFLALAQDALDMTFGLTDRPRLFQQFGLTKDTVVLFKKFDEGRADFPVDEELGLDLGDLSRFLVTHSMRLVTEFNSQTSAKIFAARILNHLLLFVNQTLAAHRELLAGFGEAAPRFRGQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 854367 - protein, 603 aa, Homo sapiens
LLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDLQDEDVATFLALAQDALDMTFGLTDRPRLFQQFGLTKDTVVLFKKVGQAQVWVGVRLQRPLTHLLLSSLMRGGQTSPWTRSLAWTWGICRASWSHTACAWSRSSTARCVGCSAWAGGVPGRVVQGWGCLGWGSCGVMSTLPTVDVCQDLRGQDPQPPAAVCQPDAGCAPGAPSGLWGGSSPLPGAGTGGLGERGSGRVAGASMDSLPQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 854368 - protein, 619 aa, Homo sapiens
ATEPGCGGRGGGLSSSPKPYWSLCCSLGGHEEALVLGLSTARAQGRMEQHACSLLGCQVWRGCSWGCGGLGHSRPHPPDAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDLQDEDVATFLALAQDALDMTFGLTDRPRLFQQFGLTKDTVVLFKKVGQAQVWVGVRLQRPLTHLLLSSLMRGGQTSPWTRSLAWTWGICRASWSHTACAWSRSSTARCVAAVPGLGVSQGRVVQGWGCLGWGSCGVMSTLPTVDVCQDLRGQDPQPPAAVCQPDAGCAPGAPSGLWGGSSPLPGAGTGGLGERGSGRVAGASMDSLPQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 854369 - protein, 566 aa, Homo sapiens
LLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDALDMTFGLTDRPRLFQQFGLTKDTVVLFKKFDEGRADFPVDEELGLDLGDLSRFLVTHSMRLVTEFNSQVRRLQCLGWGCPRVESSRDGGAYGWGSCGVMSTLPTVDVCQDLRGQDPQPPAAVCQPDAGCAPGAPSGLWGGSSPLPGAGTGGLGERGSGRVAGASMDSLPQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 854370 - protein, 494 aa, Homo sapiens
SAELQARRNFPLPARPAARTVGAGRFLLGSASPSVMEKTCIDALPLTMNSSEKQETVCIFGTGDFGRSLGLKMLQCGYSVVFGSRNPQKTTLLPSGAEVLSYSEAAKKSGIIIIAIHREHYDFLTELTEVLNGKILVDISNNLKINQYPESNAEYLAHLVPGAHVVKAFNTISAWALQSGALDASRQVFVCGNDSKAKQRVMDIVRNLGLTPMDQGSLMAAKEIEKYPLQLFPMWRFPFYLSAVLCVFLFFYCVIRDVIYPYVYEKKDNTFRMAISIPNRIFPITAPYTACFGLPPWCYCCHSTTVPRHKIPSFPDWLDHWMLCRKQLGLVALGFAFLHVLYTLVIPIRYYVRWRLGNLTVTQAILKKENPFSTSSAWLSDSYVALGILGFFLFVLLGITSLPSVSNAVNWREFRFVQSKLGYLTLILCTAHTLVYGGKRFLSPSNLRWYLPAAYVLGLIIPCTVLVIKFVLIMPCVDNTLTRIRQGWERNSKH

SEQ ID NO: 854371 - protein, 318 aa, Homo sapiens
SAELQARRNFPLPARPAARTVGAGRFLLGSASPSVMEKTCIDALPLTMNSSEKQETVCIFGTGDFGRSLGLKMLQCGYSVVFGSRNPQKTTLLPSGAEVLSYSEAAKKSGIIIIAIHREHYDFLTELTEVLNGKILVDISNNLKINQYPESNAEYLAHLVPGAHVVKAFNTISAWALQSGALDASRQAILKKENPFSTSSAWLSDSYVALGILGFFLFVLLGITSLPSVSNAVNWREFRFVQSKLGYLTLILCTAHTLVYGGKRFLSPSNLRWYLPAAYVLGLIIPCTVLVIKFVLIMPCVDNTLTRIRQGWERNSKH

SEQ ID NO: 854372 - protein, 283 aa, Homo sapiens
MEKTCIDALPLTMNSSEKQETVCIFGTGDFGRSLGLKMLQCGYSVVFGSRNPQKTTLLPSGAEVLSYSEAAKKSGIIIIAIHREHYDFLTELTEVLNGKILVDISNNLKINQYPESNAEYLAHLVPGAHVVKAFNTISAWALQSGALDASRQVFVCGNDSKAKQRVMDIVRNLGLTPMDQGSLMAAKEIEKYPLQLFPMWRFPFYLSAVLCVFLFFYCVIRDVIYPYVYEKKDNTFRMAISIPNRIFPITAPYTACFGLPPWCYCCHSTTVPRHKIPSIPRLA

SEQ ID NO: 854373 - protein, 283 aa, Homo sapiens; identical to SEQ ID NO: 854372

SEQ ID NO: 854374 - protein, 283 aa, Homo sapiens; identical to SEQ ID NO: 854372

SEQ ID NO: 854375 - protein, 298 aa, Homo sapiens
CVRALPVFVACSSGWVAHFLAAPGLRGKKRLLTLLLKHRTSCTELFAKLFQPRMAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSELSRPPKASSAIRWECVSPGSFPGDIIAAEATHSTISCFAINTLPATILPSKNVNRKYFS

SEQ ID NO: 854376 - protein, 330 aa, Homo sapiens
CVRALPVFVACSSGWVAHFLAAPGLRGKKRLLTLLLKHRTSCTELFAKLFQPRMAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDCENSETATKEGISEEKSQGLPQEPSFRGISEQLSRPPKASSAIRWECVSPGSFPGDIIAAEATHSTISCFAINTLPATILPSKNVNRKYFS

SEQ ID NO: 854377 - protein, 195 aa, Homo sapiens
CVRALPVFVACSSGWVAHFLAAPGLRGKKRLLTLLLKHRTSCTELFAKLFQPRMAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQQLSK

SEQ ID NO: 854378 - protein, 587 aa, Homo sapiens
CVRALPVFVACSSGWVAHFLAAPGLRGKKRLLTLLLKHRTSCTELFAKLFQPRMAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDCENSETATKEGISEEKSQGLPQEPSFRGISEHESNLVWKQGSATGEKLRSPSQGGSFSQVIFTNKSLGKRDLYDEAERCLILTTDSIMCQKVPPEERPYRCDVCGHSFKQHSSLTQHQRIHTGEKPYKCNQCGKAFSLRSYLIIHQRIHSGEKAYECSECGKAFNQSSALIRHRKIHTGEKACKCNECGKAFSQSSYLIIHQRIHTGEKPYECNECGKTFSQSSKLIRHQRIHTGERPYECNECGKAFRQSSELITHQRIHSGEKPYECSECGKAFSLSSNLIRHQRIHSGEEPYQCNECGKTFKRSSALVQHQRIHSGDEAYICNECGKAFRHRSVLMRHQRVHTIK

SEQ ID NO: 854379 - protein, 539 aa, Homo sapiens
MAVESGVISTLIPQDPPEQELILVKVEDNFSWDEKFKQNGSTQSCQELFRQQFRELCYQWLMPELHTKEQILELLVLEQFLSILPEELQIWVQQHNPESGEEAVTLLEDLEREFDDPGQQGGNRRKVMWEKEFTAGACNGIITVPASPQGPAVPWKDLTCLRASQESTDIHLQPLKTQLKSWKPCLSPKSDCENSETATKEGISEEKSQGLPQEPSFRGISEHESNLVWKQGSATGEKLRSPSQGGSFSQVIFTNKSLGKRDLYDEAERCLILTTDSIMCQKVPPEERPYRCDVCGHSFKQHSSLTQHQRIHTGEKPYKCNQCGKAFSLRSYLIIHQRIHSGEKAYECSECGKAFNQSSALIRHRKIHTGEKACKCNECGKAFSQSSYLIIHQRIHTGEKPYECNECGKTFSQSSKLIRHQRIHTGERPYECNECGKAFRQSSELITHQRIHSGEKPYECSECGKAFSLSSNLIRHQRIHSGEEPYQCNECGKTFKRSSALVQHQRIHSGDEAYICNECGKAFRHRSVLMRHQRVHTIK

SEQ ID NO: 854380 - protein, 330 aa, Homo sapiens; identical to SEQ ID NO: 854376

SEQ ID NO: 854381 - protein, 189 aa, Homo sapiens
MAVESGVISTLIPQDPPEQELILVKVEDNFSWDEKFKQNGSTQSCQELFRQQFRELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSGEEWEIIWKLLTLRPLFLRMQN

SEQ ID NO: 854382 - protein, 209 aa, Homo sapiens
CVRALPVFVACSSGWVAHFLAAPGLRGKKRLLTLLLKHRTSCTELFAKLFQPRMAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQGGNRRKVMWEKEFTAWSM

SEQ ID NO: 854383 - protein, 260 aa, Homo sapiens
CVRALPVFVACSSGWVAHFLAAPGLRGKKRLLTLLLKHRTSCTELFAKLFQPRMAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSGEEWEIIWKLLTLRPLFLRMQN

SEQ ID NO: 854384 - protein, 571 aa, Homo sapiens
CVRALPVFVACSSGWVAHFLAAPGLRGKKRLLTLLLKHRTSCTELFAKLFQPRMAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDCENSETATKEGISEENESNLVWKQGSATGEKLRSPSQGGSFSQVIFTNKSLGKRDLYDEAERCLILTTDSIMCQKVPPEERPYRCDVCGHSFKQHSSLTQHQRIHTGEKPYKCNQCGKAFSLRSYLIIHQRIHSGEKAYECSECGKAFNQSSALIRHRKIHTGEKACKCNECGKAFSQSSYLIIHQRIHTGEKPYECNECGKTFSQSSKLIRHQRIHTGERPYECNECGKAFRQSSELITHQRIHSGEKPYECSECGKAFSLSSNLIRHQRIHSGEEPYQCNECGKTFKRSSALVQHQRIHSGDEAYICNECGKAFRHRSVLMRHQRVHTIK

SEQ ID NO: 854385 - protein, 209 aa, Homo sapiens; identical to SEQ ID NO: 854382

SEQ ID NO: 854386 - protein, 241 aa, Homo sapiens
CVRALPVFVACSSGWVAHFLAAPGLRGKKRLLTLLLKHRTSCTELFAKLFQPRMAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDFS

SEQ ID NO: 854387 - protein, 347 aa, Homo sapiens
CVRALPVFVACSSGWVAHFLAAPGLRGKKRLLTLLLKHRTSCTELFAKLFQPRMAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDCENSETATKEGISEEKSQGLPQEPSFRGISEQLSRPPKASSAIRWECVSPGSFPGDIIAAEATHSTISCFAINTLPATILPSKNVNRKCKYHLLPMTEETVVAGTQTQ

SEQ ID NO: 854388 - protein, 1912 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854389 - protein, 246 aa, Homo sapiens
IKGDKKRQSEERAAQHSCTCPTCEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKKEEEEKKEVMLQNGETPKDLNDEKQKKNIKQRFMFNNLQMVVLLELTVTFGSMTERAAKVNKEELHEIWTSVAGIDLNWVIARDSLNHGICRGGKTFRIEPDMPILNEAFKGEMTGGMLRDQM

SEQ ID NO: 854390 - protein, 146 aa, Homo sapiens
MLFNLLLQALFLIQGMFVSLFPIHLVGQLVSLLHLSHLEDGIKIEENSLKEEESIEGEKEVKSTAPETAIECTQAPAPASEDEKVVVEPPEGEEKVEKAEVKERTEEPMETEPKGKGIHIFFVCLFVLRQCSAAARLECCGAILAY

SEQ ID NO: 854391 - protein, 1899 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854392 - protein, 1610 aa, Homo sapiens
MSFSSCQSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854393 - protein, 1566 aa, Homo sapiens
TARYEAGLGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854394 - protein, 1707 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTE

SEQ ID NO: 854395 - protein, 1912 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQAQHSCTCPTCEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854396 - protein, 1912 aa, Homo sapiens; identical to SEQ ID NO: 854388

SEQ ID NO: 854397 - protein, 706 aa, Homo sapiens
DNKEGEDSSVIHYDDKAIELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854398 - protein, 1912 aa, Homo sapiens; identical to SEQ ID NO: 854388

SEQ ID NO: 854399 - protein, 1469 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854400 - protein, 1804 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKVSGWGGIYCLSDKLESA

SEQ ID NO: 854401 - protein, 485 aa, Homo sapiens
KKKYDQQDHHPRKTPTPSTPGDTQPNTPAPVPPAEDGIKIEENSLKQEETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854402 - protein, 1649 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSA

SEQ ID NO: 854403 - protein, 1534 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQQQ

SEQ ID NO: 854404 - protein, 1784 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKQRNLWRQSPKVLLMYEKVEEKSAIDLTPIVVEDKEEKKEEEEKKEVMLQNGETPKDLNDEKQKKNIKQRFMFNNLQMVVLLELTVTFGSMTERAAKVNKEELHEIWTSVAGIDLNWVIARDSLNHGICRGGKTFRIEPDMPILNEAFKGEMTGGMLRDQM

SEQ ID NO: 854405 - protein, 282 aa, Homo sapiens [sequence omitted]

SEQ ID NO: 854406 - protein, 282 aa, Homo sapiens [sequence omitted]

SEQ ID NO: 854407 - protein, 1534 aa, Homo sapiens; identical to SEQ ID NO: 854403

SEQ ID NO: 854408 - protein, 1372 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRGVCGRPRPPPMGRSTRAVG

SEQ ID NO: 854409 - protein, 1224 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLGWGRGAQTVMSNRVGIQWPGHPVTRGG

SEQ ID NO: 854410 - protein, 1120 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNGEREGVV

SEQ ID NO: 854411 - protein, 933 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEE

SEQ ID NO: 854412 - protein, 610 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEG

SEQ ID NO: 854413 - protein, 34 aa, Homo sapiens
MLDLLEDFLEHEGYKYERIDGGITGNMRQEAIDR

SEQ ID NO: 854414 - protein, 266 aa, Homo sapiens
TARYEAGLGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRRTGPIWERGTVMQG

SEQ ID NO: 854415 - protein, 1905 aa, Homo sapiens
MASGLGSPSPCSAGSEEEDMDALLNNSLPPPHPENEEDPEEDLSETETPKLKKKKKPKKPRDPKIPKSKRQKKELGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854416 - protein, 1685 aa, Homo sapiens
WDFGGKFGNLNVGKQAEVEKILFSPSLVLWYIFGYILILGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854417 - protein, 1912 aa, Homo sapiens; identical to SEQ ID NO: 854388

SEQ ID NO: 854418 - protein, 1713 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKMRNRRKILNNVSCLTLQMVVLLSCTPFGRMKSGQPQLPRRLMRSGIDGMTTGC

SEQ ID NO: 854419 - protein, 1966 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGSSVLSFSPDPASEDEKVVVEPPEGEEKVEKGRGVRVEDTGEKSYGAQEPYRLLLMIGKGVRKKSSIIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854420 - protein, 1953 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQEKRGPLSERLPYLASPRAATLALRQNQTGRREAPKRLEEQY

SEQ ID NO: 854421 - protein, 1850 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESLKDENLLCMKLMDSIQYQC

SEQ ID NO: 854422 - protein, 1757 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQHPNSSSW

SEQ ID NO: 854423 - protein, 1608 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAQLLPGLLPLFS

SEQ ID NO: 854424 - protein, 240 aa, Homo sapiens
MLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 854425 - protein, 1533 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELDCCGVSTLCVEK

SEQ ID NO: 854426 - protein, 1235 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGS

SEQ ID NO: 854427 - protein, 1065 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKLLIVNGII

SEQ ID NO: 854428 - protein, 926 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHN

SEQ ID NO: 854429 - protein, 361 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKNVRYRADL

SEQ ID NO: 854430 - protein, 573 aa, Homo sapiens
MAAVKEPLEFHAKRPWRPEEAVEDPDEEDEDNTSEAENGFSLEEVLRLGGTKQDYLMLATSPSLPVLAAGITILLTDRNLNTTFFDPAGGGDPIYTNTYSDFSVTLKFIFFILPGFGIISHIVTYYSGKKEPFGYIGMVCAMISMWLPRVYRVSTPYITVGIDVDTPAYFTLRLHNQSLIPNGVKYLSCSATLHGALWNDPAEALSQDHLLPGEGRTGLFTTHLKPHTDSQVGQPCIRGCPTGLSTSYGQRRIIGFPSTASTTKYSSQSPTDTDDTQHEDGSERAGTRRKRAPRPPTTPEHSRQRERRRDKAGESTAKLSKRKDKRARQTARETGRGRREQASDRNAGTEQSNNTDAEETTAKQKKHDRREQRREQREESSQEGKKTHKTENQTGTDTENREQGTAQARKSGRLKQQDERAERHNKTENHEDIDGKQEARTRHSGEQPNQEKETASGEKETQDVDRDRETAHEAEVTEARTRGRGGEERKSRERRRGKRRRADDRNRKTNRHEKDTHTRDKLQDGSSSRRESSKRERALEKERNGNRGASEEVQEQAGGKEERREVDTTRTRR

SEQ ID NO: 854431 - protein, 1054 aa, Homo sapiens [sequence omitted]

SEQ ID NO: 854432 - protein, 1041 aa, Homo sapiens
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLIEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEVRLMYCFNKLVSNSLDGRLNVMTGYTTEMQKVSSRKRNILKRRGLKPLKKLKNKGNELLM

SEQ ID NO: 854433 - protein, 997 aa, Homo sapiens
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLIEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEVRLMYCFNKLAILHYF

SEQ ID NO: 854434 - protein, 798 aa, Homo sapiens
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLIEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPGKYKP

SEQ ID NO: 854435 - protein, 193 aa, Homo sapiens
KFITVLRIRQKLTEYLSTTTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEFGHLLDENMGSKFDNIGMNAMANKDNASLKQLRWEAERDDWLHNRDAKSIIKKKKHFKKKRIKTTQKTKKQRK

SEQ ID NO: 854436 - protein, 1054 aa, Homo sapiens [sequence omitted]

SEQ ID NO: 854437 - protein, 1005 aa, Homo sapiens
MCSQDYLMLATLDENEEVIDGGKKGAIDDLQQGELEAFIQNLNLAKYTKASLIEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEFGHLLDENMGSKFDNIGMNAMANKDNASLKQLRWEAERDDWLHNRDAKSIIKKKKHFKKKRIKTTQKTKKQRK

SEQ ID NO: 854438 - protein, 448 aa, Homo sapiens
SYARYMILRKSDNEDIARCCKMMQDKRCDMTCDCIDTTKRNETIVEPNCTERIQILYSDGINESIRGVASCDATYCTNLADLRGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEFGHLLDENMGSKFDNIGMNAMANKDNASLKQLRWEAERDDWLHNRDAKSIIKKKKHFKKKRIKTTQKTKKQRK

SEQ ID NO: 854439 - protein, 889 aa, Homo sapiens
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLIEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGFIVDGCGYILYRNNTYGSGLK

SEQ ID NO: 854440 - protein, 550 aa, Homo sapiens
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLIEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYR

SEQ ID NO: 854441 - protein, 177 aa, Homo sapiens
MANTAPQTPTGTYFSRKLRFWNLEFESQSFLYRQVGSVLGPSPGGGAEGGQAPVQSWLWVVGGSGSQVRRMTAVLVGHGRLWVTGTEETAVLVGHGRLWVTGGSGSQVRRMTAVLVAVGLGALAPAQVKTILESQDPLGKHQTRVAPAHGLFLKSVLYGNLGAASCTLQGPQFGSHG

SEQ ID NO: 854442 - protein, 303 aa, Homo sapiens
MSSAPASGSVRARYLVYFQYVGTDFNGVAAVRGTQRAVGVQNYLEEAAERLNSVEPVRFTISSRTDAGVHALSNAAHLDVQRRSGRPPFPPEVLAEALNTHLRHPAIRVLRAFRVPSDFHARHAATSRTYLYRLATGCHRRDELPVFERNLCWTLPADCLDMVAMQEAAQHLLGTHDFSAFQSAGSPVPSPVRTLRRVSVSPGQASPLVTPEESRKLRFWNLEFESQSFLYRQVRRMTAVLVAVGLGALAPAQVKTILESQDPLGKHQTRVAPAHGLFLKSVLYGNLGAASCTLQGPQFGSHG

SEQ ID NO: 854443 - protein, 368 aa, Homo sapiens
MSSAPASGSVRARYLVYFQYVGTDFNGVAAVRGTQRAVGVQNYLEEAAERLNSVEPVRFTISSRTDAGVHALSNAAHLDVQRRSGRPPFPPEVLAEALNTHLRHPAIRVLRAFRVPSDFHARHAATSRTYLYRLATGCHRRDELPVFERNLCWTLPAEKPPSTSSAHTTSAPSSPLAARCRAPCERCAGSPFPQAKPAPWSPPRRAGSCGSGTWSLRASLSCIDRYGSVLGPSPGGGAEGGQAPVQSWLWVVGGSGSQVRRMTAVLVGHGRLWVTGTEDEAVLVGHGRLWVTGGSGSQVRRMTAVLVAVGLGALAPAQVKTILESQDPLGKHQTRVAPAHGLFLKSVLYGNLGAASCTLQGPQFGSHG

SEQ ID NO: 854444 - protein, 306 aa, Homo sapiens
GEGSGPGLRRRRRPQGRAPPVTSARFCPSGVAAVRGTQRAVGVQNYLEEAAERLNSVEPVRFTISSRTDAGVHALSNAAHLDVQRRSGRPPFPPEVLAEALNTHLRHPAIRVLRAFRVPSDFHARHAATSRTYLYRLATGCHRRDELPVFERNLCWTLPADCLDMVAMQEAAQHLLGTHDFSAFQSAGSPVPSPVRTLRRVSVSPGQASPLVTPEESRKLRFWNLEFESQSFLYRQVRRMTAVLVAVGLGALAPAQVKTILESQDPLGKHQTRVAPAHGLFLKSVLYGNLGAASCTLQGPQFGSHG

SEQ ID NO: 854445 - protein, 303 aa, Homo sapiens; identical to SEQ ID NO: 854442

SEQ ID NO: 854446 - protein, 215 aa, Homo sapiens
MVAMQEAAQHLLGTHDFSAFQSAGSPVPSPVRTLRRVSVSPGQASPLVTPEESRKLRFWNLEFESQSFLYRQVGSVLGPSPGGGAEGGQAPVQSWLWVVGGSGSQVRRMTAVLVGHGRLWVTGTEDEAVLVGHGRLWVTGGSGSQVRRMTAVLVAVGLGALAPAQVKTILESQDPLGKHQTRVAPAHGLFLKSVLYGNLGAASCTLQGPQFGSHG

SEQ ID NO: 854447 - protein, 139 aa, Homo sapiens [sequence omitted]

SEQ ID NO: 854448 - protein, 504 aa, Homo sapiens
EFICRLLPREFPGEGSCSPSPEDKAWGSSSFPGSLHSPQASPIQGTRRRDAAMDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854449 - protein, 509 aa, Homo sapiens
AGRGRRRAAGAAGREFPGEGSCSPSPEDKAWGSSSFPGSLHSPQASPIQGTRRRDAAMDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854450 - protein, 401 aa, Homo sapiens
MLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854451 - protein, 358 aa, Homo sapiens
MVGSVTASEVAVALIIMAFSFQDDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854452 - protein, 451 aa, Homo sapiens
IHLSTATTGVPRRRILQPESRGVREDPRPLSPLTSPESQSSGFPNPGDSAPGRCYGRHFHSVPGGQRSRRSPVAGQHGERPQPGLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854453 - protein, 389 aa, Homo sapiens
MVGSVTASEVAVALIIMAFSFQDDLVANGALVSICNKYGEMPVDKAKAPLRELLRGPSPHPLACVLSSLPTCLLPLYHSLGCFSSLERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854454 - protein, 540 aa, Homo sapiens
AGRGRRRAAGAAGREFPGEGSCSPSPEDKAWGSSSFPGSLHSPQASPIQGTRRRDAAMDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRGPSPHPLACVLSSLPTCLLPLYHSLGCFSSLERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854455 - protein, 190 aa, Homo sapiens
MDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPLSHHCGKKGCKRK

SEQ ID NO: 854456 - protein, 343 aa, Homo sapiens
GGAGPAAGCGRGRTGVPRRRILQPESRPQASPIQGTRRRDAAMDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVGSHCGATSWAAG

SEQ ID NO: 854457 - protein, 344 aa, Homo sapiens
AGRGRRRAAGAAGREFPGEGSCSPSPEDKAWGSSSFPGSLHSPQASPIQGTRRRDAAMDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRISRSQCAPGWWLAAPPGLIYFSPGRLSPQFLSPFGAPGGVPGGP

SEQ ID NO: 854458 - protein, 91 aa, Homo sapiens
RGGAGGGLRARPDGSSPEKDPAARVPSSGFPNPGDSAPGRCYGRHFHSVPGGQRSRRSPVAGQHGERPQPGGRSWLLPLALGLPRGPLCCG

SEQ ID NO: 854459 - protein, 188 aa, Homo sapiens
GHSQGSSRSPELLHRPPLAGDAAQAPYPQHKHFSPVEDKAWGSSSFPGSLHSPQASPIQGTRRRDAAMDDIFTQCREGNAVAVRLWLDNTENDLNQGDDHGFSPLHWACREGRSAVVASPASSHGTTPAMGSIPFPHPYHCGPKRGGLRALSLATWCLPTWEGSAPPVTIKFIMKTGWCGDMGTDKYI

SEQ ID NO: 854460 - protein, 452 aa, Homo sapiens
MDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854461 - protein, 519 aa, Homo sapiens
GHSQGSSRSPELLHRPPLAGDAAQAPYPQHKHFSPVEDKAWGSSSFPGSLHSPQASPIQGTRRRDAAMDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854462 - protein, 318 aa, Homo sapiens
MPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854463 - protein, 417 aa, Homo sapiens
PVGPLLYNITVSMTGCQMQGGVIPTVHYIDRAPRMINISTTERPSRQAQWLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854464 - protein, 525 aa, Homo sapiens
GGAGPAAGCGRGRTGVPRRRILQPESRPQASPIQGTRRRDAAMDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRGPSPHPLACVLSSLPTCLLPLYHSLGCFSSLERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 854465 - protein, 289 aa, Homo sapiens
GGAGPAAGCGRGRTGVPRRRILQPESRPQASPIQGTRRRDAAMDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSPCSSLYSRSTRPANLVVVV

SEQ ID NO: 854466 - protein, 161 aa, Homo sapiens
GGAGPAAGCGRGRTGVPRRRILQPESRPQASPIQGTRRRDAAMDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDK

SEQ ID NO: 854467 - protein, 62 aa, Homo sapiens
LQKKPEDTNRRSADMWSFAVLLWELVTREVPFADLSNMEIGMKVRAQQHTFVLREWLVMVKI

SEQ ID NO: 854468 - protein, 489 aa, Homo sapiens
PSRTPPRGPAPPASRSRGPTASGAGAPAAGQAGLTSTSAVRARPVSPARQSQDPAASLSLHLSLPPAPGAGCARWRRRGPQAAMAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVQVLSSKSHQNNMD

SEQ ID NO: 854469 - protein, 481 aa, Homo sapiens
PSRTPPRGPAPPASRSRGPTASGAGAPAAGQAGLTSTSAVRARPVSPARQSQDPAASLSLHLSLPPAPGAGCARWRRRGPQAAMAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVHKHID

SEQ ID NO: 854470 - protein, 489 aa, Homo sapiens; identical to SEQ ID NO: 854468

SEQ ID NO: 854471 - protein, 486 aa, Homo sapiens
AGRGAPPTILGVCRVPRVIYEQRAGLDASRHRPSRGAQRAEIHSAATSQDPAASLSLHLSLPPAPGAGCARWRRRGPQAAMAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVQVLSSKSHQNNMD

SEQ ID NO: 854472 - protein, 486 aa, Homo sapiens
PSRTPPRGPAPPASRSRGPTASGAGAPAAGQAGLTSTSAVRARPVSPARQSQDPAASLSLHLSLPPAPGAGCARWRRRGPQAAMAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLLLLFWLEFAHTTVSRVKPEHDIGI

SEQ ID NO: 854473 - protein, 301 aa, Homo sapiens
PSRTPPRGPAPPASRSRGPTASGAGAPAAGQAGLTSTSAVRARPVSPARQSQDPAASLSLHLSLPPAPGAGCARWRRRGPQAAMAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTFS

SEQ ID NO: 854474 - protein, 489 aa, Homo sapiens; identical to SEQ ID NO: 854468

SEQ ID NO: 854475 - protein, 481 aa, Homo sapiens; identical to SEQ ID NO: 854469

SEQ ID NO: 854476 - protein, 481 aa, Homo sapiens; identical to SEQ ID NO: 854469

SEQ ID NO: 854477 - protein, 481 aa, Homo sapiens; identical to SEQ ID NO: 854469

SEQ ID NO: 854478 - protein, 489 aa, Homo sapiens; identical to SEQ ID NO: 854468

SEQ ID NO: 854479 - protein, 452 aa, Homo sapiens
HLPPPPPPLTPPPHSHHPPPTLSLHLSLPPPPPTPSLPPPPPPLTPPSPHPPPPPPPRAPSPPSTNPSPPRLPPLHQHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVQVLSSKSHQNNMD

SEQ ID NO: 854480 - protein, 301 aa, Homo sapiens; identical to SEQ ID NO: 854473

SEQ ID NO: 854481 - protein, 146 aa, Homo sapiens
MLEGRQTPASTLEQDATDYRLRSLRKLLAQPREGLLAPFSKRNSTASFPGRTSHIPVQQPEKRKQKPSPEPSQDSPHSDKWPPGHPVKNLPQMRGPRPRPAGDSPRKTQWLNQVESYIAEQRRGDRMRPQAPGRGWHGEEEVVAAA

SEQ ID NO: 854482 - protein, 143 aa, Homo sapiens
AGTICWVPQVLCTCRACDAVYLTQSSQTHERCSIIPFMQMKKLGLIEVEYLAQGHTVSDRTWIQPQSGAPWCVTRMIILCLVCLVWKGRGREIYQAWWHVPVVPDTQEAEAGGSPEPGEVESAVSRDHATTLQPGPQSESLSP

SEQ ID NO: 854483 - protein, 72 aa, Homo sapiens
PLYVGGVGVRRGEKQRAVVPRPRLRLVTRWASRVIKGGAETSVCQFRTPDSGAPLGKGLGVSFVKGPKAPPP

SEQ ID NO: 854484 - protein, 88 aa, Homo sapiens
GWRVAGSLSSALAPLRPPPTAPPWHWLAPGEAEAPSFLRRFPPHSRRPSASRWEVSVARASAPQRMWQPRAMALAVRVVYCIFSSRRS

SEQ ID NO: 854485 - protein, 83 aa, Homo sapiens
GWRVAGSLSSALAPLRPPPTAPPWHWLAPGEAEAPSFLRRFPPHSRRPSASRWEVSVARASAPQRMWQPRAMALAVRVVYCGA

SEQ ID NO: 854486 - protein, 83 aa, Homo sapiens; identical to SEQ ID NO: 854485

SEQ ID NO: 854487 - protein, 83 aa, Homo sapiens; identical to SEQ ID NO: 854485

SEQ ID NO: 854488 - protein, 72 aa, Homo sapiens; identical to SEQ ID NO: 854483

SEQ ID NO: 854489 - protein, 83 aa, Homo sapiens; identical to SEQ ID NO: 854485

SEQ ID NO: 854490 - protein, 72 aa, Homo sapiens; identical to SEQ ID NO: 854483

SEQ ID NO: 854491 - protein, 72 aa, Homo sapiens; identical to SEQ ID NO: 854483

SEQ ID NO: 854492 - protein, 72 aa, Homo sapiens; identical to SEQ ID NO: 854483

SEQ ID NO: 854493 - protein, 83 aa, Homo sapiens; identical to SEQ ID NO: 854485

SEQ ID NO: 854494 - protein, 72 aa, Homo sapiens; identical to SEQ ID NO: 854483

SEQ ID NO: 854495 - protein, 102 aa, Homo sapiens
RGAGRPGSMSVPSGGAGAVLRAPACAPRAGLGLFQDAHVRTETPDRGSSRLERAPPAWGGLSTSRFRPTEGVGGARPGDLRVKELGQDLTNARETARGFVRL

SEQ ID NO: 854496 - protein, 483 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 854497 - protein, 257 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQLAWDQWQGPRNLKVLTKMTCCC

SEQ ID NO: 854498 - protein, 341 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKVWKLEGPLENLEKSKVLFISQAKSIAESIIIPGLRMLKRELCPQQSLFLSFFLFFYCIRIQYNENLLQSKSAN

SEQ ID NO: 854499 - protein, 149 aa, Homo sapiens
MGENGIGGTSRIQGTVQSETSTVMDLELSLPLDEGMDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 854500 - protein, 483 aa, Homo sapiens; identical to SEQ ID NO: 854496

SEQ ID NO: 854501 - protein, 409 aa, Homo sapiens
MSRCAPAWATEVLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 854502 - protein, 364 aa, Homo sapiens
MEHLLHSRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 854503 - protein, 235 aa, Homo sapiens [sequence omitted]

SEQ ID NO: 854504 - protein, 483 aa, Homo sapiens; identical to SEQ ID NO: 854496

SEQ ID NO: 854505 - protein, 238 aa, Homo sapiens [sequence omitted]

SEQ ID NO: 854506 - protein, 319 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKLQNTSAPCKKNFDKALNDIGIWVCPNTGILCGGRSEECNLLSPMKELPDTLVPFGSNSPPMGGSPERFKGLTPWIHFKKLKPNNFLANEATTSQEVNGRRPPNIEKDPGPYTERECERQQGAPENT

SEQ ID NO: 854507 - protein, 512 aa, Homo sapiens
GGGAPGGLQEAAGDARQPGRSGTPEEEENMSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 854508 - protein, 409 aa, Homo sapiens; identical to SEQ ID NO: 854501

SEQ ID NO: 854509 - protein, 483 aa, Homo sapiens; identical to SEQ ID NO: 854496

SEQ ID NO: 854510 - protein, 483 aa, Homo sapiens; identical to SEQ ID NO: 854496

SEQ ID NO: 854511 - protein, 371 aa, Homo sapiens [sequence omitted]

SEQ ID NO: 854512 - protein, 421 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPTPRPRQAQVSFLRSF

SEQ ID NO: 854513 - protein, 355 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDATSRMRENFCNLSICKGLISRICKVLKLIYEEQNSPIKKWEKDLNRHFSIEDIDATISMKKA

SEQ ID NO: 854514 - protein, 238 aa, Homo sapiens [sequence omitted]

SEQ ID NO: 854515 - protein, 431 aa, Homo sapiens
MQKATYYDNAAAALFGGYSSYPGSNGFGFDVPPQPPFQAATHLEGDYQRSACSLQSLGNAAPHAKSKELNGSCMRPGLAPETLSAPPGSPPPSAAPTSATSNSSNGGGPSKSGPPKCGPGTNSTLTKQIFPWMKESRQTSKLKNNSPGTAEGCGGGGGGGGGGGSGGSGGGGGGGGGGDKSPPGSAASKRARTAYTSAQLVELEKEFHFNRYLCRPRRVEMANLLNLSERQIKIWFQNRRMKYKKDQKAKGLASSSGGPSPAGSPPQPMQSTAGFMNALHSMTPSYESPSPPAFGKAHQNAYALPSNYQPPLKGCGAPQKYPPTPAPEYEPHVLQANGGAYGTPTMQGSPVYVGGGGYADPLPPPAGPSLYGLNHLSHHPSGNLDYNGAPPMAPSQHHGPCEPHPTYTDLSSHHAPPPQGRIQEAPKLTHL

SEQ ID NO: 854516 - protein, 431 aa, Homo sapiens; identical to SEQ ID NO: 854515

SEQ ID NO: 854517 - protein, 167 aa, Homo sapiens
MVIDGEGDAAQVERFVHLPGVQEWVGGTTQSILYLAHTCWYWSWLAFPCATRRSCTVLSSQLTSAKMSGFSSELLCEATRMEVISASVLILEVEKWSESSVVKWPYTKVGDIQNRGEIGLSAPLGGREAVGVGGEMALCECGRPADWRWNWPQCLSWRWRSGQSPWW

SEQ ID NO: 854518 - protein, 167 aa, Homo sapiens; identical to SEQ ID NO: 854517

SEQ ID NO: 854519 - protein, 167 aa, Homo sapiens; identical to SEQ ID NO: 854517

SEQ ID NO: 854520 - protein, 113 aa, Homo sapiens
MDEDVLHPEEPHHRLLLRFTDDTFDPELAATIGTNLRLFYDVCKLSYPQEAAVGREQEEAVPTVERRKLEVPPAWSAHVFFLNTRQTVTVFPDRTGIGRTPYRKHPCCGRFHF

SEQ ID NO: 854521 - protein, 167 aa, Homo sapiens; identical to SEQ ID NO: 854517

SEQ ID NO: 854522 - protein, 438 aa, Homo sapiens
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKVCTSPSRRMFNNPICTLPTYRLPPYKLSLL

SEQ ID NO: 854523 - protein, 89 aa, Homo sapiens
GGPPPGIDLFFPPPPGIFEWMVVKAFVVLNPDYKSHDQEQLIKEIQEHVKKTTAPYKYPRKVEFIQELPKTISGKTKRNELRKKEWKTI

SEQ ID NO: 854524 - protein, 528 aa, Homo sapiens
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKIVDVNGNVLPPGQEGDIGIQVLPNRPFGLFTHYVDNPSKTASTLRGNFYITGDRGYMDKDGYFWFVARADDVILSSGYRIGPFEVENALNEHPSVAESAVVSSPDPIRGEGSKGFCRSKS

SEQ ID NO: 854525 - protein, 178 aa, Homo sapiens
RVSACLTFCSAVSSLLLAVAVCASRCGMYVLAPFDFFGSVSASALCLVYVLLVFCRFVRAMCVVGPAHSCAPGVRALCFCWCVFVVRALVVASPVCFFVVYGLSPLVFLFVRFSSFPPCLPLSWASCSSLVLFARLCFSSFASGVSAFVCCRCAVVVCVVLFCCIVCSVSPPARGLTF

SEQ ID NO: 854526 - protein, 215 aa, Homo sapiens
PSTPITWEITKVLEALGQEPRMKTQYSYKFKSLKHCVSAGEPITPDVTEKWRNKTGLDIYEGYGQTETVLICGNFKGMKIKPGSMGKPSPAFDVKIVDVNGNVLPPGQEGDIGIQVLPNRPFGLFTHYVDNPSKTASTLRGNFYITGDRGYMDKDGYFWFVARADDVILSSGYRIGPFEVENALNEHPSVAESAVVSSPDPIRGEGSKGFCRSKS

SEQ ID NO: 854527 - protein, 85 aa, Homo sapiens
APEGPPQAVFSLLVRMEVVKAFVVLNPDYKSHDQEQLIKEIQEHVKKTTAPYKYPRKVEFIQELPKTISGKTKRNELRKKEWKTI

SEQ ID NO: 854528 - protein, 528 aa, Homo sapiens; identical to SEQ ID NO: 854524

SEQ ID NO: 854529 - protein, 452 aa, Homo sapiens
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKIVDVNGNVLPPGQEGDIGIQVLPNRPFGLFTHYVGSKGFCRSKS

SEQ ID NO: 854530 - protein, 241 aa, Homo sapiens
MMTYEWYLPKMAKHLPGVNFPGNRWNPVEGILPSGMVTFNLYHFLEVNKQKETFVCIGIHEGDPTWKKNYSLWPWGSCDKLVPLEIVFNPEEWIKLTKSIYNWTEEYGRFDPSSWESVANEEMWQARMKTPFFIFNLAETAHMPSKVKAQLYAQAYDLYKEIVYLQKEHPVNWHKNYAIACERMLRLQARDADPEVLLSETIRHFRLYSQKAPNDPQQADILGALKHLRKELQSLRNRKNV

SEQ ID NO: 854531 - protein, 114 aa, Homo sapiens [sequence omitted]

SEQ ID NO: 854532 - protein, 708 aa, Homo sapiens
DPEAAVAAAQAALVSRLGSSVSHRVLGLAVSFSLGRHWPMSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFRLSGSSAGGILAAGVFSFSRLTWQWSIAAEVFSLNNLFVGLLMALTVHFEEAATAKERSKVAKIGAFCCGLSLCNQHTIILYVLCIIPWILFQLLKKKELSLGSLLKLSLYFSAGLLPYVHLPISSYLNHARWTWGDQTTLQGFLTHFLREEYGTFSLAKSEIGSSMSEILAFSSNKYEDRTLIQHPSPCSLCKYMFSNKVERFWMQSNAVVAVLAGIGLAAVVSETNRVLNSNGLQCLEWLSATLFVVYQIYSNYSVCDQRTNYVIDKFAKNLLTSMPHDAIILLRGDLPGNSLRYMHYCEGLRPDISLVDQEMMTYEWYLPKMAKHLPGVNFPGNRWNPVEGILPSGMVTFNLYHFLEVNKQKETFVCIGIHEGDPTWKKNYSLWPWGSCDKLVPLEIVFNPEEWIKLTKSIYNWTEEYGRFDPSSWESVANEEMWQARMKTPFFIFNLAETAHMPSKVKAQLYAQAYDLYKEIVYLQKEHPVNWHKNYAIACERMLRLQARDADPEVLLSETIRHFRLYSQKAPNDPQQADILGALKHLRKELQSLRNRKNV

SEQ ID NO: 854533 - protein, 746 aa, Homo sapiens
DPEAAVAAAQAALVSRLGSSVSHRVLGLAVSFSLGRHWPMSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFRLSGSSAGGILAAGVFSFSRLTWQWSIAAEVFSLNNLFVGLLMALTVHFEEAATAKERSKVAKIGAFCCGLSLCNQHTIILYVLCIIPWILFQLLKKKELSLGSLLKLSLYFSAGLLPYVHLPISSYLNHARWTWGDQTTLQGFLTHFLREEYGTFSLAKSEIGSSMSEILLSQVTNMRTELSFNIQALAVCANICLATKDRQNPSLVWLFTGMFCIYSLFFAWRANLDISKPLFMGVVERFWMQSNAVVAVLAGIGLAAVVSETNRVLNSNGLQCLEWLSATLFVVYQIYSNYSVCDQRTNYVIDKFAKNLLTSMPHDAIILLRGDLPGNSLRYMHYCEGLRPDISLVDQEMMTYEWYLPKMAKHLPGVNFPGNRWNPVEGILPSGMVTFNLYHFLEVNKQKETFVCIGIHEGDPTWKKNYSLWPWGSCDKLVPLEIVFNPEEWIKLTKSIYNWTEEYGRFDPSSWESVANEEMWQARMKTPFFIFNLAETAHMPSKVKAQLYAQAYDLYKEIVYLQKEHPVNWHKNYAIACERMLRLQARDADPEVLLSETIRHFRLYSQKAPNDPQQADILGALKHLRKELQSLRNRKNV

SEQ ID NO: 854534 - protein, 363 aa, Homo sapiens
DPEAAVAAAQAALVSRLGSSVSHRVLGLAVSFSLGRHWPMSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFRLSGSSAGGILAAGVFSFSRLTWQWSIAAEVFSLNNLFVGLLMALTVHFEEAATAKERSKVAKIGAFCCGLSLCNQHTIILYVLCIIPWILFQLLKKKELSLGSLLKLSLYFSAGLLPYVHLPISSYLNHARWTWGDQTTLQGFLTHFLREEYGTFSLAKSEIGSSMSEILLSQVTNMRTELSFNIQALAVCANICLATKWNDSGCRAMQ

SEQ ID NO: 854535 - protein, 976 aa, Homo sapiens
MNAGPGCEPCTKRPRWGAATTSPAASDARSFPSRQRRVLDPKDAHVQFRVPPSSPACVPGQAGQHRGSATSLVFKQKTITSWMDTKGIKTAESESLDSKENNNTRIESMMSSVQKDNFYQHNVEKLENVSQLSLDKSLTEKSTQYLNQHQTAAMCKWQNEGKHTEQLLESEPQTVTLVPEQFSNANIDRSPQNDDHSDTDSEENRDNQQFLTTVKLANAKQTTEDEHAREAKSHQKCSKSCHPGEDCASCQQDEIDVVPKSPLSDVGSEDVGTGSKNDNKLIRQESCLGNSPPFEKESEPESPMDVDNSKNSCQDSEADEETSPGFDEQEDGSSSQTANKPSRFQARDADIEFRKRYSTKGGEVRLHFQFEGGESRTGMNDLNAKLPGNISSLNVECRNSKQHGKKDSKITDHFMRLPKAEDRRKEQWETKHQRTERKIPKYVPPHLSPDKKWLGTPIEEMRRMPQCGIRLPLLRPSANHTVTIWVDLLRAGEVPKPFPTHYKDLWDNKHVKMPCSEQNLYPVEDENGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 854536 - protein, 106 aa, Homo sapiens
MNAGPGCEPCTKRPRWGAATTSPAASDARSFPSRQRRVLDPKDAHVQFRVPPSSPACVPGQAGQHRGSATSLGTWENKNLCPSPRPEPSGLRDSSHSFLVLCASSL

SEQ ID NO: 854537 - protein, 135 aa, Homo sapiens
RFPLSATLPLCGNVRPGSWKRLTAAFRWWESERIPNQTCTKRPRWGAATTSPAASDARSFPSRQRRVLDPKDAHVQFRVPPSSPACVPGQAGQHRGSATSLGTWENKNLCPSPRPEPSGLRDSSHSFLVLCASSL

SEQ ID NO: 854538 - protein, 894 aa, Homo sapiens
MDTKGIKTAESESLDSKENNNTRIESMMSSVQKDNFYQHNVEKLENVSQLSLDKSLTEKSTQYLNQHQTAAMCKWQNEGKHTEQLLESEPQTVTLVPEQFSNANIDRSPQNDDHSDTDSEENRDNQQFLTTVKLANAKQTTEDEHAREAKSHQKCSKSCHPGEDCASCQQDEIDVVPKSPLSDVGSEDVGTGSKNDNKLIRQESCLGNSPPFEKESEPESPMDVDNSKNSCQDSEADEETSPGFDEQEDGSSSQTANKPSRFQARDADIEFRKRYSTKGGEVRLHFQFEGGESRTGMNDLNAKLPGNISSLNVECRNSKQHGKKDSKITDHFMRLPKAEDRRKEQWETKHQRTERKIPKYVPPHLSPDKKWLGTPIEEMRRMPQCGIRLPLLRPSANHTVTIWVDLLRAGEVPKPFPTHYKDLWDNKHVKMPCSEQNLYPVEDENGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 854539 - protein, 575 aa, Homo sapiens
RAEFGTRNRRRIEAGGVPVEEGRQASVYGLTWEAGGSAIAEAGSGREGMVQAGAEKDAQSISLRKEQWETKHQRTERKIPKYVPPHLSPDKKWLGTPIEEMRRMPQCGIRLPLLRPSANHTVTIWNGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 854540 - protein, 264 aa, Homo sapiens
MNAGPGCEPCTKRPRWGAATTSPAASDARSFPSRQRRVLDPKDAHVQFRVPPSSPACVPGQAGQHRGSATSLGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 854541 - protein, 108 aa, Homo sapiens
GKCHDIAVSFLFASALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 854542 - protein, 159 aa, Homo sapiens
MNAGPGCEPCTKRPRWGAATTSPAASDARSFPSRQRRVLDPKDAHVQFRVPPSSPACVPGQAGQHRGSATSLAVSLEFDQQQGSVCPSESEIYEAGAGDRMAGAPMGAAVQPAEVTVEVGEGPPRCTTFVTGRMPEALEYNLSANPEASTIFQRNSQTD

SEQ ID NO: 854543 - protein, 264 aa, Homo sapiens; identical to SEQ ID NO: 854540

SEQ ID NO: 854544 - protein, 976 aa, Homo sapiens; identical to SEQ ID NO: 854535

SEQ ID NO: 854545 - protein, 935 aa, Homo sapiens
MNAGPGCEPCTKRPRWGAATTSPAASDARSFPSRQRRVLDPKDAHVQFRVPPSSPACVPGQAGQHRGSATSLVFKQKTITSWMDTKGIKTAESESLDSKENNNTRIESMMSSVQKDNFYQHNVEKLENVSQLSLDKSLTEKSTQYLNQHQTAAMCKWQNEGKHTEQLLESEPQTVTLVPEQFSNANIDRSPQNDDHSDTDSEENRDNQQFLTTVKLANAKQTTEDEHAREAKSHQKCSKSCHPGEDCASCQQDEIDVVPKSPLSDVGSEDVGTGSKNDNKLIRQESCLGNSPPFEKESEPESPMDVDNSKNSCQDSEADEETSPGFDEQEDGSSSQTANKPSRFQARDADIEFRKRYSTKGGEVRLHFQFEGGESRTGMNDLNAKLPGNISSLNVECRNSKQHGKKDSKITDHFMRLPKAEDRRKEQWETKHQRTERKIPKYVPPHLSPDKKWLGTPIEEMRRMPQCGIRLPLLRPSANHTVTIWNGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 854546 - protein, 258 aa, Homo sapiens
MISTNRDSLTYFFTFFMPFCLFSCLIALAGETFSTVLNRSYSCHVMKGGMFLPSSVKLIVTDCLFQGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 854547 - protein, 163 aa, Homo sapiens
MNAGPGCEPCTKRPRWGAATTSPAASDARSFPSRQRRVLDPKDAHVQFRVPPSSPACVPGQAGQHRGSATSLVFKQKTITSWMDTKGIKTAESESLDSKENNNTRIESMMSSVQKDNFYQHNVEKLENVSQLSLDKSLTEKSTQYLNQHQTAAMCKWQNEGKQ

SEQ ID NO: 854548 - protein, 465 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKDKVSLCHLGWSAMAPSGLTAAPTSLGSSDPPTSASQVAGTTGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 854549 - protein, 292 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQEQQHNGPDALRS

SEQ ID NO: 854550 - protein, 492 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVLWADLECYSLYLPRKPPLLSGWIVSSSVGLRHQLELIVLDMGECYTYCVMFLPILVLSSLLIISVIDVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 854551 - protein, 476 aa, Homo sapiens
MTPLASPCVTREAKHVSFTSPIFLHFFLPSFRNNSPSSISKESLNHLSLLAYPLSLKSMQNIPEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 854552 - protein, 456 aa, Homo sapiens
MAANETSVSYMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVLWADLECYSLYLPRKPPLLSGWIVSSSVGLRHQLELIVLDMGECYTYCVMFLPILVLSSLLIISVIDVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 854553 - protein, 227 aa, Homo sapiens
MLLCPLCSPGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGEQQHNGPDALRS

SEQ ID NO: 854554 - protein, 133 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGTYR

SEQ ID NO: 854555 - protein, 174 aa, Homo sapiens
LLSDSGPPPGSSTASSAFSEERSAGRGARDRSPAGASEGFHVRGRWRTEDCHLRTKAIETLRVAGRHQLPDRSFISFGISSLQMVSSQKLEKPIEMGSSEPLPIADGDRRRKKKRRGRATDSLPGKFEDMYKLTSELLGEGAYAKVQGAVSLQNGKEYAVKVSVSAECQALLCK

SEQ ID NO: 854556 - protein, 424 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 854557 - protein, 347 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGEQQHNGPDALRS

SEQ ID NO: 854558 - protein, 466 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVLWADLECYSLYLPRKPPLLSGWIVSSSVGLRHQLELIVLDIVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 854559 - protein, 492 aa, Homo sapiens; identical to SEQ ID NO: 854550

SEQ ID NO: 854560 - protein, 259 aa, Homo sapiens [sequence omitted]

SEQ ID NO: 854561 - protein, 174 aa, Homo sapiens; identical to SEQ ID NO: 854555

SEQ ID NO: 854562 - protein, 757 aa, Homo sapiens
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRAKNKSKETFLGSVKETFDAMKNSTKEFVRHHKEKIKQAKEAVKENLKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQRYMLKELDTFCHWNELDQFINKFFLNGVFIHDQKLFTDFVNDVKDYLRNMKEYEVDNDGVFEKLDEYIYRHFFGHTFSPPYGPRSVYIKPCHYSSL

SEQ ID NO: 854563 - protein, 757 aa, Homo sapiens; identical to SEQ ID NO: 854562

SEQ ID NO: 854564 - protein, 757 aa, Homo sapiens; identical to SEQ ID NO: 854562

SEQ ID NO: 854565 - protein, 757 aa, Homo sapiens; identical to SEQ ID NO: 854562

SEQ ID NO: 854566 - protein, 613 aa, Homo sapiens
MSTFFLIVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRAKNKSKETFLGSVKETFDAMKNSTKEFVRHHKEKIKQAKEAVKENLKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQRYMLKELDTFCHWNELDQFINKFFLNGVFIHDQKLFTDFVNDVKDYLRNMKEYEVDNDGVFEKLDEYIYRHFFGHTFSPPYGPRSVYIKPCHYSSL

SEQ ID NO: 854567 - protein, 554 aa, Homo sapiens
FPNRTPFPIGMGHRNGQIPVVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRAKNKSKETFLGSVKETFDAMKNSTKEFVRHHKEKIKQAKEAVKENLKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQRYMLKELDTFCHWNELDQFINKFFLNGVFIHDQKLFTDFVNDVKDYLRNMKEYEVDNDGVFEKLDEYIYRHFFGHTFSPPYGPRSVYIKPCHYSSL

SEQ ID NO: 854568 - protein, 424 aa, Homo sapiens
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRKLFTDFVNDVKDYLRNMKEYEVDNDGVFEKLDEYIYRHFFGHTFSPPYGPSRPDKKQRMVNIENSRHRKQEQKHLQPQPYKREGKWHKYGRTNGRQMANLEIELGQLPFDPQY

SEQ ID NO: 854569 - protein, 69 aa, Homo sapiens
DGDSSGGERLESAAEQRPKRVQHRKQEQKHLQPQPYKREGKWHKYGRTNGRQMANLEIELGQLPFDPQY

SEQ ID NO: 854570 - protein, 152 aa, Homo sapiens
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETG

SEQ ID NO: 854571 - protein, 175 aa, Homo sapiens
MAQCLWKKLLIQLWRKPAQQLSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRHSQSKADRGSSSTP

SEQ ID NO: 854572 - protein, 79 aa, Homo sapiens
PLSVRECTAPEARADPGASGPVVLQPPNPECYTELRAKGGRADGLGHPSSFTGQALRCLSVWTDENPYGKMLCASPCRV

SEQ ID NO: 854573 - protein, 757 aa, Homo sapiens; identical to SEQ ID NO: 854562

SEQ ID NO: 854574 - protein, 477 aa, Homo sapiens
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRA

SEQ ID NO: 854575 - protein, 675 aa, Homo sapiens
MAQCLWKKLLIQLWRKPAQQLSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRAKNKSKETFLGSVKETFDAMKNSTKEFVRHHKEKIKQAKEAVKENLKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQRYMLKELDTFCHWNELDQFINKFFLNGVFIHDQKLFTDFVNDVKDYLRNMKEYEVDNDGVFEKLDEYIYRHFFGHTFSPPYGPRSVYIKPCHYSSL

SEQ ID NO: 854576 - protein, 807 aa, Homo sapiens
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRAKNKSKETFLGSVKETFDAMKNSTKEFVRHHKEKIKQAKEAVKENLKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQRYMLKELDTFCHWNELDQFINKFFLNGVFIHDQKLFTDFVNDVKDYLRNMKEYEVDNDGVFEKLDEYIYRHFFGHTFSPPYGPSRPDKKQRMVNIENSRHRKQEQKHLQPQPYKREGKWHKYGRTNGRQMANLEIELGQLPFDPQY

SEQ ID NO: 854577 - protein, 807 aa, Homo sapiens; identical to SEQ ID NO: 854576

SEQ ID NO: 854578 - protein, 757 aa, Homo sapiens; identical to SEQ ID NO: 854562

SEQ ID NO: 854579 - protein, 257 aa, Homo sapiens
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRHSQSKADRGSSSTP

SEQ ID NO: 854580 - protein, 73 aa, Homo sapiens
PGNFDLDSEFNPDSLMGNLARQEFGTRVFPRRHNGAHECPGRCSQEYQQCRKERQTPGCLLGRAPKSSSGFSL

SEQ ID NO: 854581 - protein, 103 aa, Homo sapiens
MSHRARDKPIRPLPRHTYFTADSAPKIDRCTYLKEERRGRDSDIIYSSVVYSTMDLLADDLSSVEKRTTTRREADGKHNIGMKHDNPPTQQELNYLTATWNRT

SEQ ID NO: 854582 - protein, 103 aa, Homo sapiens
KLRLVRGLGVSFRAHPSAIGAILQSKGSVSVSCEEAGPHLGRGSWPCRFLDRHRGEPWLGAPDCALRGSRSVGCRPQRGREPEPSTAQLGGSSGSGRSVWISL

SEQ ID NO: 854583 - protein, 106 aa, Homo sapiens
PLSSFRGRCLQALRMVQRLTYRRRLSYNTASNKTRLSRTPGNRIVYLYTKKVGKAPKSACGVCPVPPTLLFPPSFRAATMVRMNVLADALKSINNAEKRGKRQGAY

SEQ ID NO: 854584 - protein, 106 aa, Homo sapiens; identical to SEQ ID NO: 854583

SEQ ID NO: 854585 - protein, 106 aa, Homo sapiens; identical to SEQ ID NO: 854583

SEQ ID NO: 854586 - protein, 106 aa, Homo sapiens; identical to SEQ ID NO: 854583

SEQ ID NO: 854587 - protein, 106 aa, Homo sapiens; identical to SEQ ID NO: 854583

SEQ ID NO: 854588 - protein, 106 aa, Homo sapiens; identical to SEQ ID NO: 854583

SEQ ID NO: 854589 - protein, 182 aa, Homo sapiens
MSRCGRRGGPTEGDNVEPRAAISGVTQEEKLGGSETRWMGDSSPNYKKHPAAGQHQRAGSSGTNLPKDEGHSPEGATTTAGDSYNNRRGSTQQRRRDNYTKDITPPERGEPPTHDATQGNAHPTKPPGEHETHTEARRASSQRAPKRHEDHPGNNRPAAKQNTTHPQAAGNHPTHATTGKSR

SEQ ID NO: 854590 - protein, 106 aa, Homo sapiens; identical to SEQ ID NO: 854583

SEQ ID NO: 854591 - protein, 106 aa, Homo sapiens; identical to SEQ ID NO: 854583

SEQ ID NO: 854592 - protein, 130 aa, Homo sapiens
MVRMNVLADALKSINNAEKRGKRQVLIRPCSKVIVRFLTVMMKHGYIGEFEIIDDHRAGKIVVNLTGRLNKCGVISPRSDVQLKDLEKWQNNLLPSRQFGFIVLTTSAGIMDHEEARRKHTGGKILGFFF

SEQ ID NO: 854593 - protein, 130 aa, Homo sapiens; identical to SEQ ID NO: 854592

SEQ ID NO: 854594 - protein, 106 aa, Homo sapiens; identical to SEQ ID NO: 854583

SEQ ID NO: 854595 - protein, 73 aa, Homo sapiens; identical to SEQ ID NO: 854580

SEQ ID NO: 854596 - protein, 139 aa, Homo sapiens
MGGQWRHGGRVRVAENDPGREDGRRAALCWPAGPGEDGIRMDWGEAWAVKAFKASPEGKPPREMSKPSVRELRGTRRDRGTGDPEGGGNPIAPQGGPGDAKNKMDISGQNALEEAGRPRGKQGQRECTLAGHKGATRVG

SEQ ID NO: 854597 - protein, 106 aa, Homo sapiens; identical to SEQ ID NO: 854583

SEQ ID NO: 854598 - protein, 106 aa, Homo sapiens; identical to SEQ ID NO: 854583

SEQ ID NO: 854599 - protein, 106 aa, Homo sapiens; identical to SEQ ID NO: 854583

SEQ ID NO: 854600 - protein, 106 aa, Homo sapiens; identical to SEQ ID NO: 854583

SEQ ID NO: 854601 - protein, 106 aa, Homo sapiens; identical to SEQ ID NO: 854583

SEQ ID NO: 854602 - protein, 166 aa, Homo sapiens
MRINSKNHNGSLTTQRGTPQNEKARTLQHVATTSPHSHNGDPDAGNNRESPEAPTNRPHTGHPPTLAQAGNEPPTRGKKTTTTKQQTNHQQGNTSQAPPTPRTQSGNTRTASPQSPERHATPAPASTRHASQQHDTTSPATTHAPTPPHPKRTRKRRTHHERHRTK

SEQ ID NO: 854603 - protein, 106 aa, Homo sapiens; identical to SEQ ID NO: 854583

SEQ ID NO: 854604 - protein, 106 aa, Homo sapiens; identical to SEQ ID NO: 854583

SEQ ID NO: 854605 - protein, 106 aa, Homo sapiens; identical to SEQ ID NO: 854583

SEQ ID NO: 854606 - protein, 106 aa, Homo sapiens; identical to SEQ ID NO: 854583

SEQ ID NO: 854607 - protein, 106 aa, Homo sapiens; identical to SEQ ID NO: 854583

SEQ ID NO: 854608 - protein, 130 aa, Homo sapiens; identical to SEQ ID NO: 854592

SEQ ID NO: 854609 - protein, 130 aa, Homo sapiens; identical to SEQ ID NO: 854592

SEQ ID NO: 854610 - protein, 667 aa, Homo sapiens
RQWRARAAEKMSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKERTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 854611 - protein, 667 aa, Homo sapiens; identical to SEQ ID NO: 854610

SEQ ID NO: 854612 - protein, 667 aa, Homo sapiens; identical to SEQ ID NO: 854610

SEQ ID NO: 854613 - protein, 674 aa, Homo sapiens
RQWRARAAEKMSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKESVCFVHHRTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 854614 - protein, 650 aa, Homo sapiens
RQWRARAAEKMSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQHILNTEENWNSWKNEGCPSFVKERTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 854615 - protein, 519 aa, Homo sapiens
MCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKERTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 854616 - protein, 667 aa, Homo sapiens; identical to SEQ ID NO: 854610

SEQ ID NO: 854617 - protein, 350 aa, Homo sapiens
MDLQLSDSNFRRHILLQYLILFQYLKGQVKFKSSNYVLTDEQSLWIEDTTKSVYQLLSENPPDGERFSKMVEHILNTEENWNSWKNEGCPSFVKERTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 854618 - protein, 281 aa, Homo sapiens [sequence omitted]

SEQ ID NO: 854619 - protein, 281 aa, Homo sapiens [sequence omitted]

SEQ ID NO: 854620 - protein, 212 aa, Homo sapiens
MPSSLVIFVPLREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 854621 - protein, 495 aa, Homo sapiens
RQWRARAAEKMSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKERTSDTKPTRIIRKRTAPEDFLGKGPTKKILMGNEELTRLWNLCPDNMEACKSETREHMPTLEEFFEEAIEQADPENMVENEYK

SEQ ID NO: 854622 - protein, 495 aa, Homo sapiens; identical to SEQ ID NO: 854621

SEQ ID NO: 854623 - protein, 317 aa, Homo sapiens
RQWRARAAEKMSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKV

SEQ ID NO: 854624 - protein, 106 aa, Homo sapiens
RQWRARAAEKMSPTPPLFSLPEARTRFTKSTREALNNKNIKPLLSTFSQVPGSENEKKCTLDQAFRGILEEEIINHSSCENVLAIISLAIGGVTEGKYGSVLFCLK

SEQ ID NO: 854625 - protein, 667 aa, Homo sapiens; identical to SEQ ID NO: 854610

SEQ ID NO: 854626 - protein, 387 aa, Homo sapiens
RQWRARAAEKMSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQVSSTRNKPMIEKMEI

SEQ ID NO: 854627 - protein, 519 aa, Homo sapiens; identical to SEQ ID NO: 854615

SEQ ID NO: 854628 - protein, 350 aa, Homo sapiens; identical to SEQ ID NO: 854617

SEQ ID NO: 854629 - protein, 281 aa, Homo sapiens [sequence omitted]

SEQ ID NO: 854630 - protein, 233 aa, Homo sapiens
RRTRGSPRLYHEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 854631 - protein, 153 aa, Homo sapiens
MNSLLILPGNQELLSSHLHVFTVTLNLPVISESVISKIGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 854632 - protein, 563 aa, Homo sapiens
RQWRARAAEKMSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKESVCFVHHRTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPVSTIDQLFIPFS

SEQ ID NO: 854633 - protein, 994 aa, Homo sapiens
LRAYAGWSPRPAAAAMSVLGEYERHCDSINSDFGSESGGCGDSSPGPSASQGPRAGGGAAEQEELHYIPIRVLGRGAFGEATLYRRTEDDSLVVWKEVDLTRLSEKERRDALNEIVILALLQHDNIIAYYNHFMDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQDPEQRPTADELLDRPLLRKRRREMEEKVTLLNAPTKRPRSSTVTEAPIAVVTSRTSEVYVWGGGKSTPQKLDVIKSGCSARQVCAGNTHFAVVTVEKELYTWVNMQGGTKLHGQLGHGDKASYRQPKHVEKLQGKAIRQVSCGDDFTVCVTDEGQLYAFGSDYYGCMGVDKVAGPEVLEPMQLNFFLSNPVEQVSCGDNHVVVLTRNKEVYSWGCGEYGRLGLDSEEDYYTPQKVDVPKALIIVAVQCGCDGTFLLTQSGKVLACGLNEFNKLGLNQCMSGIINHEAYHEVPYTTSFTLAKQLSFYKIRTIAPGKTHTAAIDERGRLLTFGCNKCGQLGVGNYKKRLGINLLGGPLGGKQVIRVSCGDEFTIAATDDNHIFAWGNGGNGRLAMTPTERPHGSDICTSWPRPIFGSLHHVPDLSCRGWHTILIVEKVLNSKTIRSNSSGLSIGTVFQSSSPGGGGGGGGGEEEDSQQESETPDPSGGFRGTMEADRGMEGLISPTEAMGNSNGASSSCPGWLRKELENAEFIPMPDSPSPLSAAFSESEKDTLPYEELQGLKVASEAPLEHKPQVEASSPRLNPAVTCAGKGTPLTPPACACSSLQVEVERLQGLVLKCLAEQQKLQQENLQIFTQLQKLNKKLEGGQQVGMHSKGTQTAKEEMEMDPKPDLDSDSWCLLGTDSCRPSL

SEQ ID NO: 854634 - protein, 828 aa, Homo sapiens
MVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQDPEQRPTADELLDRPLLRKRRREMEEKVTLLNAPTKRPRSSTVTEAPIAVVTSRTSEVYVWGGGKSTPQKLDVIKSGCSARQVCAGNTHFAVVTVEKELYTWVNMQGGTKLHGQLGHGDKASYRQPKHVEKLQGKAIRQVSCGDDFTVCVTDEGQLYAFGSDYYGCMGVDKVAGPEVLEPMQLNFFLSNPVEQVSCGDNHVVVLTRNKEVYSWGCGEYGRLGLDSEEDYYTPQKVDVPKALIIVAVQCGCDGTFLLTQSGKVLACGLNEFNKLGLNQCMSGIINHEAYHEVPYTTSFTLAKQLSFYKIRTIAPGKTHTAAIDERGRLLTFGCNKCGQLGVGNYKKRLGINLLGGPLGGKQVIRVSCGDEFTIAATDDNHIFAWGNGGNGRLAMTPTERPHGSDICTSWPRPIFGSLHHVPDLSCRGWHTILIVEKVLNSKTIRSNSSGLSIGTVFQSSSPGGGGGGGGGEEEDSQQESETPDPSGGFRGTMEADRGMEGLISPTEAMGNSNGASSSCPGWLRKELENAEFIPMPDSPSPLSAAFSESEKDTLPYEELQGLKVASEAPLEHKPQVEASSPRLNPAVTCAGKGTPLTPPACACSSLQVEVERLQGLVLKCLAEQQKLQQENLQIFTQLQKLNKKLEGGQQVGMHSKGTQTAKEEMEMDPKPDLDSDSWCLLGTDSCRPSL

SEQ ID NO: 854635 - protein, 994 aa, Homo sapiens; identical to SEQ ID NO: 854633

SEQ ID NO: 854636 - protein, 285 aa, Homo sapiens
HELVPSTARQVRDMMQRSKNRPRMATILIVEKVLNSKTIRSNSSGLSIGTVFQSSSPGGGGGGGGGEEEDSQQESETPDPSGGFRGTMEADRGMEGLISPTEAMGNSNGASSSCPGWLRKELENAEFIPMPDSPSPLSAAFSESEKDTLPYEELQGLKVASEAPLEHKPQVEASSPRLNPAVTCAGKGTPLTPPACACSSLQVEVERLQGLVLKCLAEQQKLQQENLQIFTQLQKLNKKLEGGQQVGMHSKGTQTAKEEMEMDPKPDLDSDSWCLLGTDSCRPSL

SEQ ID NO: 854637 - protein, 751 aa, Homo sapiens
LRAYAGWSPRPAAAAMSVLGEYERHCDSINSDFGSESGGCGDSSPGPSASQGPRAGGGAAEQEELHYIPIRVLGRGAFGEATLYRRTEDDSLVVWKEVDLTRLSEKERRDALNEIVILALLQHDNIIAYYNHFMDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQDPEQRPTADELLDRPLLRKRRREMEEKVTLLNAPTKRPRSSTVTEAPIAVVTSRTSEVYVWGGGKSTPQKLDVIKSGCSARQVCAGNTHFAVVTVEKELYTWVNMQGGTKLHGQLGHGDKASYRQPKHVEKLQGKAIRQVSCGDDFTVCVTDEGQLYAFGSDYYGCMGVDKVAGPEVLEPMQLNFFLSNPVEQVSCGDNHVVVLTRNKEVYSWGCGEYGRLGLDSEEDYYTPQKVDVPKALIIVAVQCGCDGTFLLTQSGKVLACGLNEFNKLGLNQCMSGIINHEAYHEVPYTTSFTLAKQLSFYKIRTIAPGKTHTAAIDERGRLLTFGCNKCGQLGVGNYKKRLGINLLGGPLGGKQVIRVSCGDEFTIAATDDNHIFAWGNGGNGRLAMTPTERPHGSDICTSWPRPIFGSLHHVPDLSCRGWHTILIVGKSFICLGLGWL

SEQ ID NO: 854638 - protein, 540 aa, Homo sapiens
LRAYAGWSPRPAAAAMSVLGEYERHCDSINSDFGSESGGCGDSSPGPSASQGPRAGGGAAEQEELHYIPIRVLGRGAFGEATLYRRTEDDSLVVWKEVDLTRLSEKERRDALNEIVILALLQHDNIIAYYNHFMDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQDPEQRPTADELLDRPLLRKRRREMEEKVTLLNAPTKRPRSSTVTEAPIAVVTSRTSEVYVWGGGKSTPQKLDVIKSGCSARQVCAGNTHFAVVTVEKELYTWVNMQGGTKLHGQLGHGDKASYRQPKHVEKLQGKAIRQVSCGDDFTVCVTDEGQLYAFGSDYYGCMGVDKVAGPEVLEPMQLNFFLSNPVEQVSCGDNHVVVLTRNKEVYSWGCGEYGRGSLVSVHFFTGIQP

SEQ ID NO: 854639 - protein, 150 aa, Homo sapiens
LRAYAGWSPRPAAAAMSVLGEYERHCDSINSDFGSESGGCGDSSPGPSASQGPRAGGGAAEQEELHYIPIRVLGRGAFGEATLYRRTEVAALGAGRPVWRCRVAPSPSFSAPLSQRRELSALGAHGVYVLGSSPLFPLTGTRNWLDHWFD

SEQ ID NO: 854640 - protein, 828 aa, Homo sapiens; identical to SEQ ID NO: 854634

SEQ ID NO: 854641 - protein, 846 aa, Homo sapiens
LRAYAGWSPRPAAAAMSVLGEYERHCDSINSDFGSESGGCGDSSPGPSASQGPRAGGGAAEQEELHYIPIRVLGRGAFGEATLYRRTEDDSLVVWKEVDLTRLSEKERRDALNEIVILALLQHDNIIAYYNHFMDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQDPEQRPTADELLDRPLLRKRRREMEEKVTLLNAPTKRPRSSTVTEAPIAVVTSRTSEVYVWGGGKSTPQKLDVIKSGCSARQVCAGNTHFAVVTVEKELYTWVNMQGGTKLHGQLGHGDKASYRQPKHVEKLQGKAIRQVSCGDDFTVCVTDEGQLYAFGSDYYGCMGVDKVAGPEVLEPMQLNFFLSNPVEQVSCGDNHVVVLTRNKEVYSWGCGEYGRLGLDSEEEYNHIFAWGNGGNGRLAMTPTERPHGSDICTSWPRPIFGSLHHVPDLSCRGWHTILIVEKVLNSKTIRSNSSGLSIGTVFQSSSPGGGGGGGGGEEEDSQQESETPDPSGGFRGTMEADRGMEGLISPTEAMGNSNGASSSCPGWLRKELENAEFIPMPDSPSPLSAAFSESEKDTLPYEELQGLKVASEAPLEHKPQVEASSPRLNPAVTCAGKGTPLTPPACACSSLQVEVERLQGLVLKCLAEQQKLQQENLQIFTQLQKLNKKLEGGQQVGMHSKGTQTAKEEMEMDPKPDLDSDSWCLLGTDSCRPSL

SEQ ID NO: 854642 - protein, 994 aa, Homo sapiens; identical to SEQ ID NO: 854633

SEQ ID NO: 854643 - protein, 994 aa, Homo sapiens; identical to SEQ ID NO: 854633

SEQ ID NO: 854644 - protein, 689 aa, Homo sapiens
LRAYAGWSPRPAAAAMSVLGEYERHCDSINSDFGSESGGCGDSSPGPSASQGPRAGGGAAEQEELHYIPIRVLGRGAFGEATLYRRTEDDSLVVWKEVDLTRLSEKERRDALNEIVILALLQHDNIIAYYNHFMDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQDPEQRPTADELLDRPLLRKRRREMEEKVTLLNAPTKRPRSSTVTEAPIAVVTSRTSEVYVWGGGKSTPQKLDVIKSGCSARQVCAGNTHFAVVTVEKELYTWVNMQGGTKLHGQLGHGDKASYRQPKHVEKLQGKAIRQVSCGDDFTVCVTDEGQLYAFGSDYYGCMGVDKVAGPEVLEPMQLNFFLSNPVEQVSCGDNHVVVLTRNKEVYSWGCGEYGRLGLDSEEDYYTPQKVDVPKALIIVAVQCGCDGTFLLTQSGKVLACGLNEFNKLGLNQCMSGIINHEAYHEVPYTTSFTLAKQLSFYKIRTIAPGKTHTAAIDERGRLLTFGCNKCGQLGVGNYKKRLGINLLGGPLGGKQVIRVSCSNGKLITSSAEFSSSSS

SEQ ID NO: 854645 - protein, 870 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854646 - protein, 119 aa, Homo sapiens [sequence omitted]

SEQ ID NO: 854647 - protein, 1076 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRQVPRGESPLFLPLRGATPQLIGSPTPLSPQSLGLKRALGWFSVAASPSLRVSKGTEGGCVLVLRPLQASGLSAAPDQIGLSSCPVGWCEPHAKLRMLTADLPGEGRGGTESGFWEASMSPHHGFLVSLLGPLLILTKVVAPGVCPSIAVGSSGHPEGFRAVDSGIRPHTGHNLHSLLGTRPGPMKLLTMLCFSLTYLPCPRVWTVSTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854648 - protein, 870 aa, Homo sapiens; identical to SEQ ID NO: 854645

SEQ ID NO: 854649 - protein, 533 aa, Homo sapiens
KLWLGTRLGVIGRVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854650 - protein, 870 aa, Homo sapiens; identical to SEQ ID NO: 854645

SEQ ID NO: 854651 - protein, 870 aa, Homo sapiens; identical to SEQ ID NO: 854645

SEQ ID NO: 854652 - protein, 929 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPRKTPLAGAQLGPNELSRPSRANPLLDYGPRGAWLCLSARGAFNGTPVGPQGTLSRWRLGGPFAPAPLLLGDPRGSPKVGGKA

SEQ ID NO: 854653 - protein, 609 aa, Homo sapiens
LGRAWFKSDEGARPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854654 - protein, 599 aa, Homo sapiens
SSCSRVSQCTESQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854655 - protein, 464 aa, Homo sapiens
MAFEAIVKKQIVKLKEPSLKCVDLVVSELATVIKKCAEKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854656 - protein, 818 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHRPTPQRRHGVQPYTRPGTASRKTRGTQITGAPTMITKSTEGGESKTDTDLRKTQQ

SEQ ID NO: 854657 - protein, 494 aa, Homo sapiens
AALLLLYNSRRRRSIKTPDLGDSGPACDWHIGLRGCALLSQALLPMRVWGVRRQPLFSCLGSLLVPTPSLLARPGNALAAAPLARLGLVLTVTPALPQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854658 - protein, 659 aa, Homo sapiens
GLGLHGGCGGGSGSGGGGGGGGGGGGGGGGSGGGLGPGAAAAAAGPGAGSKMAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 854659 - protein, 477 aa, Homo sapiens
MLPLEPYLTQTSAVPQMSHFMCHSPTHKPQGLLPWAPFHQASVSLYPISPWPSESVCPPTCPGGASCWFPAGNAWDRVELGFLGFGAGGVSIAVPGFPLSCGQGCCAGGWLGHGARFPAKLRAFPQVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854660 - protein, 359 aa, Homo sapiens
PDLGCSDLVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854661 - protein, 659 aa, Homo sapiens; identical to SEQ ID NO: 854658

SEQ ID NO: 854662 - protein, 670 aa, Homo sapiens
GLGLHGGCGGGSGSGGGGGGGGGGGGGGGGSGGGLGPGAAAAAAGPGAGSKMAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGEQGPPQCPANPGGRPRRRPGPSASSPDVSLLDTGMPTAYDLSSVIASGSSVGHNNLIPLGSSGAQGSGGGSTSAHYAVNSQFTMGGPAISMASPMSIPTNTMHYGS

SEQ ID NO: 854663 - protein, 636 aa, Homo sapiens
GLGLHGGCGGGSGSGGGGGGGGGGGGGGGGSGGGLGPGAAAAAAGPGAGSKMAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLGSSGAQGSGGGSTSAHYAVNSQFTMGGPAISMASPMSIPTNTMHYGS

SEQ ID NO: 854664 - protein, 636 aa, Homo sapiens; identical to SEQ ID NO: 854663

SEQ ID NO: 854665 - protein, 740 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFSKDPSGIYQWPATCQARAGARSAAMRPGRLPHPYPVAAAYLCISGMCVHQ

SEQ ID NO: 854666 - protein, 636 aa, Homo sapiens; identical to SEQ ID NO: 854663

SEQ ID NO: 854667 - protein, 659 aa, Homo sapiens; identical to SEQ ID NO: 854658

SEQ ID NO: 854668 - protein, 346 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLHKVFLGWESPCRAGLL

SEQ ID NO: 854669 - protein, 428 aa, Homo sapiens [sequence omitted]

SEQ ID NO: 854670 - protein, 499 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLGIGKPDEVLWFVLMYGLLNVD

SEQ ID NO: 854671 - protein, 346 aa, Homo sapiens; identical to SEQ ID NO: 854668

SEQ ID NO: 854672 - protein, 363 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRRPHPLLAQFDHCKCLHSVFY

SEQ ID NO: 854673 - protein, 210 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGNPEPRAVPSSRCL

SEQ ID NO: 854674 - protein, 74 aa, Homo sapiens [sequence omitted]

SEQ ID NO: 854675 - protein, 146 aa, Homo sapiens
MRPFMTPQPPLHTDVNNNKRATRTRKGYTHVPNTTHTIQLEEKSRNTPPHPMPKQTEHKNNTHIVGDAKKKQTQPSNAAKTVTRYALMQLTKNYNRDGENLKDKHETPTKKETNRRQNHNPQQDFASVPPTKPTHKHHIDPQHKIT

SEQ ID NO: 854676 - protein, 867 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAMKNTTTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854677 - protein, 870 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854678 - protein, 726 aa, Homo sapiens
MSDVRVSGVIVRGQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAMKNIQTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854679 - protein, 458 aa, Homo sapiens
WYGSEYGIKEPSLKCVDLVVSELATVIKKCAEKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854680 - protein, 434 aa, Homo sapiens [sequence omitted]

SEQ ID NO: 854681 - protein, 659 aa, Homo sapiens; identical to SEQ ID NO: 854658

SEQ ID NO: 854682 - protein, 504 aa, Homo sapiens
AALLLLYNSRRRRSIKTPDLGDSGPACDWHIGLRGCALLSQALLPMRVWGVRRQPLFSCLGSLLVPTPSLLARPGNALAAAPLARLGLVLTVTPALPQILLLIDIEQSYINTNHEDFIGFANCYYTEQLVTCAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854683 - protein, 659 aa, Homo sapiens; identical to SEQ ID NO: 854658

SEQ ID NO: 854684 - protein, 636 aa, Homo sapiens; identical to SEQ ID NO: 854663

SEQ ID NO: 854685 - protein, 326 aa, Homo sapiens
KLWLGTRLGVIGREKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 854686 - protein, 255 aa, Homo sapiens
MPRHTCGLSQDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLGSSGAQGSGGGSTSAHYAVNSQFTMGGPAISMASPMSIPTNTMHYGS

SEQ ID NO: 854687 - protein, 208 aa, Homo sapiens [sequence omitted]

SEQ ID NO: 854688 - protein, 263 aa, Homo sapiens
MARYEAGCNRPRDFLEVKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 854689 - protein, 577 aa, Homo sapiens
GLGLHGGCGGGSGSGGGGGGGGGGGGGGGGSGGGLGPGAAAAAAGPGAGSKMAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTFPTTVTAFPSLPCPGRDLAGTSPSKKRKKEKERKNK

SEQ ID NO: 854690 - protein, 117 aa, Homo sapiens
MLGPGSQWAALASSLTLAPVQGRPLCLAGHRTAQRGPGAPGRGRWGVALWGMESQGGRGGTRTLDTILNEGSSLGGTLPRSSWAGKAHVGQAFYKCGHQGRLHPQALLGCRGISTSH

SEQ ID NO: 854691 - protein, 525 aa, Homo sapiens [sequence omitted]

SEQ ID NO: 854692 - protein, 363 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLHPPPGSPRVAGLGLCGWWWRGVLGASQLPPMPP

SEQ ID NO: 854693 - protein, 401 aa, Homo sapiens
GLGLHGGCGGGSGSGGGGGGGGGGGGGGGGSGGGLGPGAAAAAAGPGAGSKMAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVVSRASRVLLQ

SEQ ID NO: 854694 - protein, 145 aa, Homo sapiens
LGKRDGGAHRPHSSALSSQLELTGGQEQGVGSVGPLISHSPPPSAFSTCVVHVASRATRTPPMRPLCLFPQLSSYPRLREETERIVTTYIREREGRTKDQILLLIDIEQSYINTNHEDFIGFAKVGTFRDWLVGRHQSSLSDPRR

SEQ ID NO: 854695 - protein, 441 aa, Homo sapiens [sequence omitted]

SEQ ID NO: 854696 - protein, 441 aa, Homo sapiens [sequence omitted]

SEQ ID NO: 854697 - protein, 846 aa, Homo sapiens
MKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGERRGSPRPSASAIPFPSRGPAPSRARAFQPLSPQAPWSWSGRCRWRWCCTSSGPGAAALGSRSAWGWAQSCWSTWVRGCAVGPPGSACTGTAPRSAARRAAPCRRRSYSPTARHSPPPRPSQSSFCRRSNKAPLPRNLVSAWAGAEGSRAAEAGAVSMNSDPRRAPPSAHALRACQRLRPCAHAQLRGRLRPACERVAPAFPEPAGQSPGSWRSALPLVLGPLTRGPAARSIRSMLLLTRSPTAWHRLSQLKPPVLPGTLGGQALHLRSWLLSRQGPAETGGQGQPQGPGLRTRLLITGLFGAGLGGAWLALRAEKERLQQQKRTEALRQAAVGQGDFHLLDHRGRARCKADFRGQWVLMYFGFTHCPDICPDELEKLVQVVRQLEAEPGLPPVQPVFITVDPERDDVEAMARYVQDFHPRLLGLTGSTKQVAQASHSYRVYYNAGPKDEDQDYIVDHSIAIYLLNPDGLFTDYYGRSRSAEQISDSVRRHMAAFRSVLS

SEQ ID NO: 854698 - protein, 493 aa, Homo sapiens
MKRDGGRLSEADIRGFVAAVVNGSAQGAQIGAWGGLGVPDPDWEVSPRDFGSLGVRRCPTTSTGPRVPHRCGLHPHAYPHIPGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRRGTPWLRVHRDGPALSGPQSRALQEALVLSDRAPFAAPSPFAELVLPPQQ

SEQ ID NO: 854699 - protein, 152 aa, Homo sapiens
MKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQVRGATDQSLIQVDDGDPGQNH

SEQ ID NO: 854700 - protein, 152 aa, Homo sapiens; identical to SEQ ID NO: 854699

SEQ ID NO: 854701 - protein, 441 aa, Homo sapiens [sequence omitted]

SEQ ID NO: 854702 - protein, 456 aa, Homo sapiens
MKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITAPGFSIVSNLLCLPQASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRRGTPWLRVHRDGPALSGPQSRALQEALVLSDRAPFAAPSPFAELVLPPQQ

SEQ ID NO: 854703 - protein, 401 aa, Homo sapiens
MKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRRGTPWLRVHRDGPALSGPQSRALQEALVLSDRAPFAAPSPFAELVLPPQQ

SEQ ID NO: 854704 - protein, 467 aa, Homo sapiens
MAPWSWSGRCRWRWCCTSSGPGAAALGSRSAWGWAQSCWSTWVRGCAVGPPGSACTGTAPRSAARRAAPCRRRSYSPTARHSPPPRPSQSSFCRRSNKAPLPRNLVSAWAGAEGSRAAEAGAVSMNRDPRRAPPSAHALRACQRLRPCAHAQLRGRLRPACERVAPAFPEPAGQSPGSWRSALPLVLGPLTRGPAARSIRSMLLLTRSPTAWHRLSQLKPPVLPGTLGGQALHLRSWLLSRQGPAETGGQGQPQGPGLRTRLLITGLFGAGLGGAWLALRAEKERLQQQKRTEALRQAAVGQGDFHLLDHRGRARCKADFRGQWVLMYFGFTHCPDICPDELEKLVQVVRQLEAEPGLPPVQPVFITVDPERDDVEAMARYVQDFHPRLLGLTGSTKQVAQASHSYRVYYNAGPKDEDQDYIVDHSIAIYLLNPDGLFTDYYGRSRSAEQISDSVRRHMAAFRSVLS

SEQ ID NO: 854705 - protein, 476 aa, Homo sapiens
MKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRREHQIHAAADSEPHSLAQALSAQASGPPWDPGRPGPASEVLAFVKAGPCRDRWAGPAPGPWASNPAADHRPVRGWTRWGLAGPEG

SEQ ID NO: 854706 - protein, 441 aa, Homo sapiens [sequence omitted]

SEQ ID NO: 854707 - protein, 441 aa, Homo sapiens [sequence omitted]

SEQ ID NO: 854708 - protein, 467 aa, Homo sapiens
MAPWSWSGRCRWRWCCTSSGPGAAALGSRSAWGWAQSCWSTWVRGCAVGPPGSACTGTAPRSAARRAAPCRRRSYSPTARHSPPPRPSQSSFCRRSNKAPLPRNLVSAWAGAEGSRAAEAGAVSMNSDPRRAPPSAHALRACQRLRPCAHAQLRGRLRPACERVAPAFPEPAGQSPGSWRSALPLVLGPLTRGPAARSIRSMLLLTRSPTAWHRLSQLKPPVLPGTLGGQALHLRSWLLSRQGPAETGGQGQPQGPGLRTRLLITGLFGAGLGGAWLALRAEKERLQQQKRTEALRQAAVGQGDFHLLDHRGRARCKADFRGQWVLMYFGFTHCPDICPDELEKLVQVVRQLEAEPGLPPVQPVFITVDPERDDVEAMARYVQDFHPRLLGLTGSTKQVAQASHSYRVYYNAGPKDEDQDYIVDHSIAIYLLNPDGLFTDYYGRSRSAEQISDSVRRHMAAFRSVLS

SEQ ID NO: 854709 - protein, 467 aa, Homo sapiens; identical to SEQ ID NO: 854708

SEQ ID NO: 854710 - protein, 394 aa, Homo sapiens
MKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTPWLRVHRDGPALSGPQSRALQEALVLSDRAPFAAPSPFAELVLPPQQ

SEQ ID NO: 854711 - protein, 152 aa, Homo sapiens; identical to SEQ ID NO: 854699

SEQ ID NO: 854712 - protein, 203 aa, Homo sapiens
MISNVLRLGVYVLGYIASHRYVGPEGSLGQPQTDIGGTKANSNKGGLLVVEQRVHAMGSPLQPLHLVLVHCCAWQRGAPNRYTRARVCPVCAPSWDVQPANYRPCEAHNFSRAQFPLLLPMKSATKGNGVAWHGRVNHNRRVSWGESDERSTKLERKPCALTVRRTATSLYCHANGALLDHATPVGHKALANLQSTGLQIPPY

SEQ ID NO: 854713 - protein, 109 aa, Homo sapiens
MGLGAGPGQTLTRMLPGYALHDPSRPRAPAFTFGARFPTQQTTCGPGPGHLVPARMTVRGTDGAPAYSIYGRPRRSAPFLTPGPGQDPRAPGHPNAELPPGRPTWEPPT

SEQ ID NO: 854714 - protein, 441 aa, Homo sapiens [sequence omitted]

SEQ ID NO: 854715 - protein, 441 aa, Homo sapiens [sequence omitted]

SEQ ID NO: 854716 - protein, 179 aa, Homo sapiens
MAWGGATAGAVSQLRTQRGGARASGEAGTPALRRVRTSRPHRGREGDSREPQTPETHAGRDRPGITPADGPGPRRPGSSACPGAPGDWPGRGVQGFPGAATAELRPPGGPTRLPSWGAAAPPPAVDRCARTLNPTVPTRGRGRVPGLGSGASGRGQRPKQARSDGSLDDPGNRGPTRAW

SEQ ID NO: 854717 - protein, 441 aa, Homo sapiens [sequence omitted]

SEQ ID NO: 854718 - protein, 152 aa, Homo sapiens; identical to SEQ ID NO: 854699

SEQ ID NO: 854719 - protein, 228 aa, Homo sapiens
MAWGGATAGAVSQLRTQRGGARASGEAGTPALRRVRTSRPHRGREGDSREPQTPETHAGRDRPGITPADGPGPRRPGSSACPGAPGDWPGRGVQGFPGAATAELRPPGGPTRLPSWGAAAPPPAVDRCARTLNPTVPTRGRGRVPGLGSGASGRGQRPKQVRAGLKSRGGEAGGRHGRGRHRHGTEGRTPERHGKGVGTGARGSDTDAGRPQTPDVSGIPAGPERWQP

SEQ ID NO: 854720 - protein, 409 aa, Homo sapiens
MLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRRGTPWLRVHRDGPALSGPQSRALQEALVLSDRAPFAAPSPFAELVLPPQQ

SEQ ID NO: 854721 - protein, 310 aa, Homo sapiens [sequence omitted]

SEQ ID NO: 854722 - protein, 429 aa, Homo sapiens
MKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADEHQIHAAADSEPHSLAQALSAQASGPPWDPGRPGPASEVLAFVKAGPCRDRWAGPAPGPWASNPAADHRPVRGWTRWGLAGPEG

SEQ ID NO: 854723 - protein, 441 aa, Homo sapiens [sequence omitted]

SEQ ID NO: 854724 - protein, 363 aa, Homo sapiens
MKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGERRGSPRPSASAIPFPS

SEQ ID NO: 854725 - protein, 298 aa, Homo sapiens
MQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADEHQIHAAADSEPHSLAQALSAQASGPPWDPGRPGPASEVLAFVKAGPCRDRWAGPAPGPWASNPAADHRPVRGWTRWGLAGPEG

SEQ ID NO: 854726 - protein, 144 aa, Homo sapiens
MKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVRNHLLSRREPIPHMQQPVHPQAAPNLKPGPKPPRPYQGFSPPCSP

SEQ ID NO: 854727 - protein, 278 aa, Homo sapiens
TQTPCPLAWERGSRSEDISVPGQKPPTCSSFSGMDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 854728 - protein, 278 aa, Homo sapiens; identical to SEQ ID NO: 854727

SEQ ID NO: 854729 - protein, 245 aa, Homo sapiens
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 854730 - protein, 278 aa, Homo sapiens; identical to SEQ ID NO: 854727

SEQ ID NO: 854731 - protein, 213 aa, Homo sapiens
LRHRVLLPGRGEADLRTSLCQARNRPPAGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 854732 - protein, 245 aa, Homo sapiens
TQTPCPLAWERGSRSEDISVPGQKPPTCSSFSGMDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVGCSRGVGCSQRRWMQSSEAYACQGE

SEQ ID NO: 854733 - protein, 245 aa, Homo sapiens; identical to SEQ ID NO: 854729

SEQ ID NO: 854734 - protein, 347 aa, Homo sapiens
TQTPCPLAWERGSRSEDISVPGQKPPTCSSFSGMDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDGLPGPKGEPGIPAIPGIRGPKGQKGEPGLPGHPGKNGPMDPLGCQGCPAPWASLESQVRRADTSRNSSQCSRSLGRPTSSPAPNSLIR

SEQ ID NO: 854735 - protein, 136 aa, Homo sapiens
FDGDSLISSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDR

SEQ ID NO: 854736 - protein, 1816 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 854737 - protein, 1702 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKSED

SEQ ID NO: 854738 - protein, 1395 aa, Homo sapiens
MEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 854739 - protein, 1798 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRSNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 854740 - protein, 846 aa, Homo sapiens
MNYITLYLDSRYKLLESKLESTLKKSLEIKEEKIAALEARLEESTNYNQQLRQELKTNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 854741 - protein, 1269 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCEQGSESLSGSPQAT

SEQ ID NO: 854742 - protein, 847 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELENELHHLEKENELLQKKITNLKITCEKIEALEQENSELERENRK

SEQ ID NO: 854743 - protein, 267 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQEL

SEQ ID NO: 854744 - protein, 1788 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 854745 - protein, 1798 aa, Homo sapiens; identical to SEQ ID NO: 854739

SEQ ID NO: 854746 - protein, 1798 aa, Homo sapiens; identical to SEQ ID NO: 854739

SEQ ID NO: 854747 - protein, 1798 aa, Homo sapiens; identical to SEQ ID NO: 854739

SEQ ID NO: 854748 - protein, 1954 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRSNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASSEYHLHQWSSHILDIPTHTIGSCAQNDLAIDMPEPLYAQARNSRTGRSHFLNQTFATIRMPSDAFGMLAKDSIGPFTVAHSSQPFLSLNTELVSNISGLPPRPVIRITDQASASLDKPAQKENEQFSDHQNPSNSNLQFSINSNNLVTSACLYPDDTEAALLVSEDNQTVWYEYGCI

SEQ ID NO: 854749 - protein, 1798 aa, Homo sapiens; identical to SEQ ID NO: 854739

SEQ ID NO: 854750 - protein, 161 aa, Homo sapiens
MKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 854751 - protein, 610 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEK

SEQ ID NO: 854752 - protein, 186 aa, Homo sapiens
PTLGGDLSASAPGPPLTQVSTPQPGRVLQPEGPFPHVPQQPGTRTQPRSHPAANDPSAAMSAAGARGLRATYHRLLDKVELMLPEKLRPLYNHPAGPRTVFFWAPIMKWGLVCAGLADMARPAEKLSTAQSAVLMATGFIWSRYSLVIIPKNWSLFAVNFFVGAAGASQLFRIWRYNQELKAKAHK

SEQ ID NO: 854753 - protein, 93 aa, Homo sapiens
ANHGGQLGLRKRAASRAQRRLGEVIILAPVAMAPPSLLPGAGGGPGAGSRQPPPPQPSRGAGRSFSVHSGQGKPREGYSRREADASRRGRKSD

SEQ ID NO: 854754 - protein, 127 aa, Homo sapiens [sequence omitted]

SEQ ID NO: 854755 - protein, 127 aa, Homo sapiens [sequence omitted]

SEQ ID NO: 854756 - protein, 127 aa, Homo sapiens [sequence omitted]

SEQ ID NO: 854757 - protein, 95 aa, Homo sapiens
MSAAGARGLRATYHRLLDKVELMLPEKLRPLYNHPAGPRTVFFWAPIMKWGLVCAGLADMARPAEKLSTAQSAVLMATGSFVKILTCIFRDPLGT

SEQ ID NO: 854758 - protein, 127 aa, Homo sapiens [sequence omitted]

SEQ ID NO: 854759 - protein, 164 aa, Homo sapiens
PTLGGDLSASAPGPPLTQPGTRTQPRSHPAANDPSAAMSAAGARGLRATYHRLLDKVELMLPEKLRPLYNHPAGPRTVFFWAPIMKWGLVCAGLADMARPAEKLSTAQSAVLMATGFIWSRYSLVIIPKNWSLFAVNFFVGAAGASQLFRIWRYNQELKAKAHK

SEQ ID NO: 854760 - protein, 127 aa, Homo sapiens [sequence omitted]

SEQ ID NO: 854761 - protein, 127 aa, Homo sapiens [sequence omitted]

SEQ ID NO: 854762 - protein, 127 aa, Homo sapiens [sequence omitted]

SEQ ID NO: 854763 - protein, 535 aa, Homo sapiens
MAALLAAAAVRARILQVSSKVKSSPTWYSASSFSSSVPTVKLFIGGKFVESKSDKWIDIHNPATNEVIGRVPQATKAEMDAAIASCKRAFPAWADTSVLSRQQVLLRYQQLIKENLKEIAKLITLEQGKTLADAEGDVFRGLQVVEHACSVTSLMMGETMPSITKDMDLYSYRLPLGVCAGIAPFNFPAMIPLWMFPMAMVCGNTFLMKPSERVPGATMLLAKLLQDSGAPDGTLNIIHGQHEAVNFICDHPDIKAISFVGSNKAGEYIFERGSRHGKRVQANMGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKGYENGNFVGPTIISNVKPNMTCYKEEIFGPVLVVLETETLDEAIQIVNNNPYGNGTAIFTTNGATARKYAHLVDVGQVGVNVPIPVPLPMFSFTGSRSSFRGDTNFYGKQGIQFYTQLKTITSQWKEEDATLSSPAVVMPTMGR

SEQ ID NO: 854764 - protein, 535 aa, Homo sapiens; identical to SEQ ID NO: 854763

SEQ ID NO: 854765 - protein, 535 aa, Homo sapiens; identical to SEQ ID NO: 854763

SEQ ID NO: 854766 - protein, 535 aa, Homo sapiens; identical to SEQ ID NO: 854763

SEQ ID NO: 854767 - protein, 252 aa, Homo sapiens
MGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKGYENGNFVGPTIISNVKPNMTCYKEEIFGPVLVVLETETLDEAIQIVNNNPYGNGTAIFTTNGATARKYAHLVDVGQVGVNVPIPVPLPMFSFTGSRSSFRGDTNFYGKQGIQFYTQLKTITSQWKEEDATLSSPAVVMPTMGR

SEQ ID NO: 854768 - protein, 415 aa, Homo sapiens
MAALLAAAAVRARILQVSSKVKSSPTWYSASSFSSSVPTVKLFIGGKFVESKSDKWIDIHNPATNEVIGRVPQATKAEMDAAIASCKRAFPAWADTSVLSRQQVLLRYQQLIKENLKEIAKLITLEQGKTLADAEGDVFRGLQVVEHACSVTSLMMGETMPSITKDMDLYSYRLPLGVCAGIAPFNFPAMIPLWMFPMAMVCGNTFLMKPSERVPGATMLLAKLLQDSGAPDGTLNIIHGQHEAVNFICDHPDIKAISFVGSNKAGEYIFERGSRHGKRVQANMGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKVTGMSHHTQPDANNFLRKLFQKLF

SEQ ID NO: 854769 - protein, 535 aa, Homo sapiens; identical to SEQ ID NO: 854763

SEQ ID NO: 854770 - protein, 535 aa, Homo sapiens; identical to SEQ ID NO: 854763

SEQ ID NO: 854771 - protein, 535 aa, Homo sapiens; identical to SEQ ID NO: 854763

SEQ ID NO: 854772 - protein, 415 aa, Homo sapiens
MAALLAAAAVRARILQVSSKVKSSPTWYSASSFSSSVPTVKLFIGGKFVESKSDKWIDIHNPATNEVIGRVPQATKAEMDAAIASCKRAFPAWADTSVLSRQQVLLRYQQLIKENLKEIAKLITLEQGKTLADAEGDVFRGLQVVEHACSVTSLMMGETMPSITKDMDLYSYRLPLGVCAGIAPFNFPAMIPLWMFPMAMVCGNTFLMKPSERVPGATMLLAKLLQDSGAPDGTLNIIHGQHEAVNFICDHPDIKAISFVGSNKAGEYIFERGSRHGKRVQANMGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKAKYDLLQRGDFWSSSCGSGDRNIG

SEQ ID NO: 854773 - protein, 146 aa, Homo sapiens
MAALLAAAAVRARILQVSSKVKSSPTWYSASSFSSSVPTVKLFIGGKFVESKSDKWIDIHNPATNEVIGRVPQATKAEMDAAIASCKRAFPAWADTSVLSRQQVLLRYQQLIKENLCQCSHSPALDPPSGETPISMANRASNSTLS

SEQ ID NO: 854774 - protein, 165 aa, Homo sapiens
MAQRLLLRRFLASVISRKPSQGQWPPLTSRALQTPQCSPGGLTVTPNPARTIYTTRISLTTFNIQDGPDFQDRVVNSETPVVVDFHAQWCGPCKILGPRLEKMVAKQHGKVVMAKVDIDDHTDLAIEYERQLVPTWLAMTDVARASKVPPIGSGSSPALLDSPLA

SEQ ID NO: 854775 - protein, 166 aa, Homo sapiens
MAQRLLLRRFLASVISRKPSQGQWPPLTSRALQTPQCSPGGLTVTPNPARTIYTTRISLTTFNIQDGPDFQDRVVNSETPVVVDFHAQWCGPCKILGPRLEKMVAKQHGKVVMAKVDIDDHTDLAIEYEVSAVPTVLAMKNGDVVDKFVGIKDEDQLEAFLKKLIG

SEQ ID NO: 854776 - protein, 166 aa, Homo sapiens; identical to SEQ ID NO: 854775

SEQ ID NO: 854777 - protein, 166 aa, Homo sapiens; identical to SEQ ID NO: 854775

SEQ ID NO: 854778 - protein, 166 aa, Homo sapiens; identical to SEQ ID NO: 854775

SEQ ID NO: 854779 - protein, 205 aa, Homo sapiens
MAQRLLLRRFLASVISRKPSQGQWPPLTSRALQTPQCSPGGLTVTPNPARTIYTTRISLTTFNIQDGPDFQDRVVNSETPVVVDFHAQWCGPCKILGPRLEKMVAKQHGKVVMAKVDIDDHTDLAIEYEAVVSVTQAGVQWHNHSSLKPQSPRLKRSSCLSLPSMGVQVSAVPTVLAMKNGDVVDKFVGIKDEDQLEAFLKKLIG

SEQ ID NO: 854780 - protein, 1312 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854781 - protein, 207 aa, Homo sapiens
MNLGRQNCSEPTSHHCTAAWATARPMSLKPQQQQQQQQQQQQQQQQQQQQQQPPPAAANVRKPGGSGLLASPAAAPSPSSSSVSSSSATAPSSVVAATSGGGRPGLGRWVSAPQPPPLRARRPLPRGPRRRPRPVTRRATRGGLGAGSAGETRSGLSPEARPVGAPGSSGIVRPVQPPAASPPPPPAVKMEGAGGLPSPRVLGGVLG

SEQ ID NO: 854782 - protein, 134 aa, Homo sapiens
MTPASNTQSPQNSFPAAQQTVFTIHPSHVQPAYTNPPHMAHVPQAHVQSGMVPSHPTAHAPMMLMTTQPPGGPQAALAQSALQPIPVSTTAHLRTSKTRPGVCTGGTVTISSASGPEASGSRVCVCSDGIQDLA

SEQ ID NO: 854783 - protein, 117 aa, Homo sapiens
GVSLLLPKLECNGVMSVHCNLHLPGSSYSPSPLSLVAVITGACHHAQLIFVFLVETGFRRVGQAGLELLTSGDPPASASQNAGITSVSHRARLHFSQFQIQGGKEFLIKVLLSDLLS

SEQ ID NO: 854784 - protein, 971 aa, Homo sapiens
MESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854785 - protein, 1306 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAELNTSELELLRYVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854786 - protein, 574 aa, Homo sapiens
MPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854787 - protein, 1228 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854788 - protein, 1338 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSGEACVCRGRRGTPKHSARTGGMAGRASASSPAFEN

SEQ ID NO: 854789 - protein, 348 aa, Homo sapiens
MVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854790 - protein, 302 aa, Homo sapiens
SAFFSAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854791 - protein, 293 aa, Homo sapiens
MPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854792 - protein, 1002 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAELNT

SEQ ID NO: 854793 - protein, 1116 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYGRKHFVCLFQCV

SEQ ID NO: 854794 - protein, 680 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGGR

SEQ ID NO: 854795 - protein, 342 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRWVSAPQPPPLRARRPLPRGPRRRPRPVTRRATRGGLGAGSAGETRSGLSPEARPVGAPGSSGIVRPVQPPAASPPPPPAVKMEGAGGLPSPRVLGGVLG

SEQ ID NO: 854796 - protein, 994 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQYQICPNSGKTSIIRVP

SEQ ID NO: 854797 - protein, 247 aa, Homo sapiens
MLLLSAPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVETGFRRVGQAGLELLTSGDPPASASQNAGITSVSHRARLHFSQFQIQGGKEFLIKVLLSDLLS

SEQ ID NO: 854798 - protein, 1294 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854799 - protein, 1224 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854800 - protein, 1309 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAALEHMNLLKELCLKYLPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854801 - protein, 1002 aa, Homo sapiens; identical to SEQ ID NO: 854792

SEQ ID NO: 854802 - protein, 1282 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQYKPTTNSSCKAALEEPKGQIPSSLLLLLPTGSTEN

SEQ ID NO: 854803 - protein, 398 aa, Homo sapiens
MASAVTSSNLIVSSGDARLANNLYGDSSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854804 - protein, 210 aa, Homo sapiens
MYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 854805 - protein, 1256 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQVIPALANFL

SEQ ID NO: 854806 - protein, 1015 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVKVRIILPVFACSLHAA

SEQ ID NO: 854807 - protein, 439 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVVLLPLASPGAPPAAPTRASPLGARASPPRSGVSLARPAPGCPRPACEPVYGPLTMSLKPQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDTQKILNGRSGD

SEQ ID NO: 854808 - protein, 1209 aa, Homo sapiens
MADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 854809 - protein, 1209 aa, Homo sapiens; identical to SEQ ID NO: 854808

SEQ ID NO: 854810 - protein, 1192 aa, Homo sapiens
MADGPRCKRRKQANPRRKNDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 854811 - protein, 228 aa, Homo sapiens
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 854812 - protein, 233 aa, Homo sapiens
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCPLFRLWTVNIRACSGL

SEQ ID NO: 854813 - protein, 160 aa, Homo sapiens
MHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 854814 - protein, 230 aa, Homo sapiens
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKSCSVTQAEVQWHSQGPLQVGLAIKPGTSVEYLAPWANQIDMALVMTVEPGFGGQKFMEDMMPKVHWLRTQFPSLDIEVDGGVGPDTVHKCAECDVSTSRFLYNCHTFLLDIYLSKA

SEQ ID NO: 854815 - protein, 228 aa, Homo sapiens; identical to SEQ ID NO: 854811

SEQ ID NO: 854816 - protein, 232 aa, Homo sapiens
MSEYMRSLQCLAYIKFSIIVNYIIITILIFLSIFSSGTLLFREVRHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 854817 - protein, 160 aa, Homo sapiens; identical to SEQ ID NO: 854813

SEQ ID NO: 854818 - protein, 246 aa, Homo sapiens
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKSCSVTQAEVQWHSQGPLQVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 854819 - protein, 157 aa, Homo sapiens
MHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEIGVQWRDLCSLQSLPAGFKRFSCLSLLSSWDYRQELT

SEQ ID NO: 854820 - protein, 212 aa, Homo sapiens
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAECDVSTSRFLYNCHTFLLDIYLSKA

SEQ ID NO: 854821 - protein, 228 aa, Homo sapiens; identical to SEQ ID NO: 854811

SEQ ID NO: 854822 - protein, 246 aa, Homo sapiens; identical to SEQ ID NO: 854818

SEQ ID NO: 854823 - protein, 228 aa, Homo sapiens; identical to SEQ ID NO: 854811

SEQ ID NO: 854824 - protein, 228 aa, Homo sapiens; identical to SEQ ID NO: 854811

SEQ ID NO: 854825 - protein, 228 aa, Homo sapiens; identical to SEQ ID NO: 854811

SEQ ID NO: 854826 - protein, 234 aa, Homo sapiens
MASGCKIGPSILNSDLANLGAECLRMLDSGADYLHLDVMDGFCLSCRHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 854827 - protein, 190 aa, Homo sapiens
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKELLISSCIYLGSLVEDPVPIFGYRGRWWSRS

SEQ ID NO: 854828 - protein, 178 aa, Homo sapiens
MHMMVSKPEQWVKPMAVAGANQYTFHLEATENPGALIKDIRENGMKSCSVTQAEVQWHSQGPLQVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 854829 - protein, 178 aa, Homo sapiens; identical to SEQ ID NO: 854828

SEQ ID NO: 854830 - protein, 228 aa, Homo sapiens; identical to SEQ ID NO: 854811

SEQ ID NO: 854831 - protein, 706 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 854832 - protein, 736 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPRYISCFVFPLSLILKCELQLVDLFFAFYPTGEGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 854833 - protein, 706 aa, Homo sapiens; identical to SEQ ID NO: 854831

SEQ ID NO: 854834 - protein, 417 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGRSAGTVVVLQHGAC

SEQ ID NO: 854835 - protein, 734 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGRSAGTVVVLQHGAVLTLDPSCSQGRFQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 854836 - protein, 531 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKVGRSFPPLLD

SEQ ID NO: 854837 - protein, 417 aa, Homo sapiens; identical to SEQ ID NO: 854834

SEQ ID NO: 854838 - protein, 738 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLVCIARFLLPLWLKMENFNRYLSNRSGSKNVFQACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 854839 - protein, 605 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLVCIARFLLPLWLKMENFNRYLSN

SEQ ID NO: 854840 - protein, 617 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKVTLMCEVLDYGN

SEQ ID NO: 854841 - protein, 531 aa, Homo sapiens; identical to SEQ ID NO: 854836

SEQ ID NO: 854842 - protein, 343 aa, Homo sapiens
MFSQFVGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 854843 - protein, 660 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLGLPGQVDLTISGRLVVCRAHGRGKRRAISRSNNKK

SEQ ID NO: 854844 - protein, 531 aa, Homo sapiens; identical to SEQ ID NO: 854836

SEQ ID NO: 854845 - protein, 184 aa, Homo sapiens [sequence omitted]

SEQ ID NO: 854846 - protein, 500 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRLSSQREILIES

SEQ ID NO: 854847 - protein, 500 aa, Homo sapiens
MYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 854848 - protein, 485 aa, Homo sapiens
MSPGTGVAVLYFRLIKPKIISVIVNSLSFTPRLNHGEFQSALLLSTFYNYDLDDHIIVPLPYPGTGVEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 854849 - protein, 531 aa, Homo sapiens; identical to SEQ ID NO: 854836

SEQ ID NO: 854850 - protein, 658 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKMLQSRLKTTCFSIQYSAFLNSETSVCEGAPISHQGNTVKNMLLFSNRFLETKL

SEQ ID NO: 854851 - protein, 713 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGENAMKRLGVTIASKSSRGHWQLVGEDPGLAFL

SEQ ID NO: 854852 - protein, 531 aa, Homo sapiens; identical to SEQ ID NO: 854836

SEQ ID NO: 854853 - protein, 226 aa, Homo sapiens [sequence omitted]

SEQ ID NO: 854854 - protein, 184 aa, Homo sapiens [sequence omitted]

SEQ ID NO: 854855 - protein, 502 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMVSYMEYDKGSSSPTPSRVFSK

SEQ ID NO: 854856 - protein, 411 aa, Homo sapiens
GGVAPGSGVRAGPRAAAAAAATVRAGLHRASCSTLATAPGAPAAGAAPAMGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQVPLEPPSET

SEQ ID NO: 854857 - protein, 188 aa, Homo sapiens [sequence omitted]

SEQ ID NO: 854858 - protein, 188 aa, Homo sapiens [sequence omitted]

SEQ ID NO: 854859 - protein, 188 aa, Homo sapiens [sequence omitted]

SEQ ID NO: 854860 - protein, 177 aa, Homo sapiens
MAASAFAGAVRAASGILRPLNILASSTYRNCVKNASLISALSTGRFSHIQTPVVSSTPRLTTSERNLTCGHTSVILNRMAPVLPSVLKLPVRSLTYFSARKGKRKTVKAVIDRFLRLHCGLWVRRKAGYKKKLWKKTPARKKRLREFVFCNKTQSKLLDKMTTSFWKRRNWHSPICR

SEQ ID NO: 854861 - protein, 188 aa, Homo sapiens [sequence omitted]

SEQ ID NO: 854862 - protein, 170 aa, Homo sapiens
MAASAFAGAVRAASGILRPLNILASSTYRNCVKNASLISALSTGRFSHIQTPVVSSTPRLTTSERNLTCGHTSVILNRMAPVLPSVLKLPVRSLTYFSARKGKRKTVKAVIDRFLRLHCGLWVRRKAGYKKKLWKKTPARKKRLREFVFCNKTQSKLLDKMTTSFWKRRN

SEQ ID NO: 854863 - protein, 1240 aa, Homo sapiens
MGVLDLSVRPVHPLQGVPRPCLPNPTVRNMVAGGPGVLEESCDHTSLLVRGTMGTVPSNGNVSAGRESGPWPKLGDHLARVLAWLRWTRVATRCPGPLERGALLLFLECPIAARMRRALREVFSYHRGVREGKGPGFEAAVTAGAEGAVPWVLITGCHSEGRCQVLNPHDSGRVGGVGIGFAVSLHALDSLAKGTSAPPQLPPWGFWASTPSPVYVPVIFGIITVVTKLPTSHSHEVGIPHEGPGVQCQHEVGEWHCLLMSYIEAMKSCGQGVQTLSWPLALVLSVKGTSRVDGRRLPPSLALSSLPQAMWRLSSVQAHLVLNLSVQGWSRDSVSPACLTQPSPLQCTTGPRARIWVARQIGPPLPGRSSFRGLIDVLWRAGPGLSFTWLSCLGEQQNRCWGPSRPRAVQPSWSCSSLELLRGVHSRAMWLWTGRPLCQQNLGRDEITMRLTSLETPTTEEETVSAPDIQLGKDAPEHWHSLPSKQPLPVGWQERQTEPAVKALSGEEGWPGGSTRRSACSSWDEPERRLLAAWLVAAITPLANPPTGRGSPSTSSSIMLLGSSEASQARENLVFGNNGGHFLPFSVPTQVGVFYHPVFLEVFFFLSQSLTLSPRLECNGAVSAHCNLCFPGSSDSPASASREAQDHPHRCRPSCPANFLFFFIEKESRYVAQAGFELLGSSDRSSRLYASQSTRIIGLSHCARPTILFLLEEFPCVEARAQRSWSSAQGPTRLRQGGSAAGGFFCSNPDSRGCEPQPWALSAWWCLHSQQGWPWGVLWSNFHGPEWDPEWLEPYAPASPAAASGAGGVGPSDYQELSEGQQVPLHWPVGSCVQGRGSWHVCLVRPCLQCQGASPLDGGRHHVLTSVQPHFTRRFGQHPIRGRAALTQRCAANRVPLRQAAVPRAFSFLPACYLQANRRPWVWDQENLPPPLAVGVPAGRLGLARRHRGVSRCREMIPGRAPEHSPGPAAAAGRSMLTAVRVSTPQAMMFNQVFPTCVSAKKPQNTLCTKGVFAQRKTTLRGFFRNAYTQLARTSCEIPAWKTTSRHRGKLCCAPALYQAASPTSPVVLGGHSCCTVPQACLSSGSQPSYQICQHPHSRLVGGESLRPSVTLSASPGQRAVAWLPRISFYGRPIRSWAGGTEGRPGSHCSVGRVAQPMRLASPTGEVPQHWPGSPHRKASVEEMKPRTMGTTATGCAKLRKLVGGAHKLFCFLVCLFVFSFKRPGTVGVSLCHPGWSAVA

SEQ ID NO: 854864 - protein, 120 aa, Homo sapiens
MSRFPAQVGWRQRWTLAWPSRQAVHTAPFRVALLPAAAAPAFRQMMTKLLSCWGKEAFPLGCFSLLAPTHWQTRRQGAQELQSLAGFAGHAQGRAMVLALLSNHGVSPSLPLEIPRDFIS

SEQ ID NO: 854865 - protein, 327 aa, Homo sapiens
MTAPCPPPPPDPQFVLRGTQSPVHALHFCEGAQAQGRPLLFSGSQSGLVHIWSLQTRRAVTTLDGHGGQCVTWLQTLPQGRQLLSQGRDLKLCLWDLAEGRSAVVDSVCLESVGFCRSSILAGGQPRWTLAVPGRGSDEVQILEMPSKTSVCALKPKADAKLGMPMCLRLWQADCSSRPLLLAGYEDGSVVLWDVSEQKVCSRIACHEEPVMDLDFDSQKARGISGSAGKALAVWSLDWQQALQVRGTHELTNPGIAEVTIRPDRKILATAGWDHRIRVFHWRTMQPLAVLAFHSAAVQCVAFTADGLLAAGSKDQRISLWSLYPRA

SEQ ID NO: 854866 - protein, 120 aa, Homo sapiens; identical to SEQ ID NO: 854864

SEQ ID NO: 854867 - protein, 374 aa, Homo sapiens
PISFSTFKVAPGLSPSEGGPSHGLWLRIPGPSSRAIRVASGNCILPSMTAPCPPPPPDPQFVLRGTQSPVHALHFCEGAQAQGRPLLFSGSQSGLVHIWSLQTRRAVTTLDGHGGQCVTWLQTLPQGRQLLSQGRDLKLCLWDLAEGRSAVVDSVCLESVGFCRSSILAGGQPRWTLAVPGRGSDEVQILEMPSKTSVCALKPKADAKLGMPMCLRLWQADCSSRPLLLAGYEDGSVVLWDVSEQKVCSRIACHEEPVMDLDFDSQKARGISGSAGKALAVWSLDWQQALQVRGTHELTNPGIAEVTIRPDRKILATAGWDHRIRVFHWRTMQPLAVLAFHSAAVQCVAFTADGLLAAGSKDQRISLWSLYPRA

SEQ ID NO: 854868 - protein, 327 aa, Homo sapiens; identical to SEQ ID NO: 854865

SEQ ID NO: 854869 - protein, 136 aa, Homo sapiens
CAGSYTAAARTLGAWLRDVIGLWTLRGAPRSRRSRLRQEGGAWTLALRGRPVPRSVATDPRTLFAGDSRSLRTGKAQRSSNKGARQIKLLPCRISQHEPDCAAVTKISNSAAATVGTAYFLLAPVGHRGWGLSDLC

SEQ ID NO: 854870 - protein, 212 aa, Homo sapiens
MTAPCPPPPPDPQFVLRGTQSPVHALHFCEGAQAQGRPLLFSGSQSGLVHIWSLQTRRAVTTLDGHGGQCVTWLQTLPQGRQLLSQGRDLKLCLWDLAEGRSAVVDSVCLESVGFCRSSILAGGQPRWTLAVPGRGSDEVQILEMPSKTSVCALKPKADAKLGMPMCLRLWQADCSSRPLLLAGYEDGSVVLWDVSEQKVCSRIACHEEPGL

SEQ ID NO: 854871 - protein, 120 aa, Homo sapiens; identical to SEQ ID NO: 854864

SEQ ID NO: 854872 - protein, 279 aa, Homo sapiens
MTAPCPPPPPDPQFVLRGTQSPVHALHFCEGAQAQGRPLLFSGSQSGLVHIWSLQTRRAVTTLDGHGGQCVTWLQTLPQGRQLLSQGRDLKLCLWDLAEGRSAVVDSVCLESVGFCRSSILAGGQPRWTLAVPGRGSDEVQILEMPSKTSVCALKPKADAKLGMPMCLRLWQADCSSRPLLLAGYEDGSVVLWDVSEQKVCSRIACHEEPVMDLDFDSQKARGISGSAGKALAVWSWPRAPRISGSASGHSTHAHDSPTPFPGDEEGGQGGGHQAPALA

SEQ ID NO: 854873 - protein, 143 aa, Homo sapiens
MKAGCSIVEKPEGGGGYQFPDWAYKTESSPGSRQIQLWHFILELLQKEEFRHVIAWQQGEYGEFVIKDPDEVARLWGRRKCKPQMNYDKLSRALRYYYNKRILHKTKGKRFTYKFNFNKLVMPNYPFINIRSSGKIQTLLVGN

SEQ ID NO: 854874 - protein, 104 aa, Homo sapiens
MKAGCSIVEKPEGGGGYQFPDWAYKTESSPGSRQIQLWHFILELLQKEEFRHVIAWQQGEYGEFVIKDPDEVARLWGRRKCKPQMNYDKLSRALREGKGFPNLC

SEQ ID NO: 854875 - protein, 348 aa, Homo sapiens
MKAGCSIVEKPEGGGGYQFPDWAYKTESSPGSRQIQLWHFILELLQKEEFRHVIAWQQGEYGEFVIKDPDEVARLWGRRKCKPQMNYDKLSRALRYYYNKRILHKTKGKRFTYKFNFNKLVMPNYPFINIRSSGVVPQSAPPVPTASSRFHFPPLDTHSPTNDVQPGRFSASSLTASGQESSNGTDRKTELSELEDGSAADWRRGVDPVSSRNAIGGGGIGHQKRKPDIMLPLFARPGMYPDPHSPFAVSPIPGRGGVLNVPISPALSLTPTIFSYSPSPGLSPFTSSSCFSFNPEEMKHYLHSQACSVFNYHLSPRTFPRYPGLMVPPLQCQMHPEESTQFSIKLQP

SEQ ID NO: 854876 - protein, 143 aa, Homo sapiens; identical to SEQ ID NO: 854873

SEQ ID NO: 854877 - protein, 122 aa, Homo sapiens
LSGPARAPRGWASCPGRREFGAVPYAARRNPVPATTAACSPPRLQSPDARESGARRGLTLGGRRLSGLTAVGAHPAAPEGPLEAGLLLCRGRPHPGRGAAGRGGPAAIPTPCQRRTQLLNIG

SEQ ID NO: 854878 - protein, 122 aa, Homo sapiens; identical to SEQ ID NO: 854877

SEQ ID NO: 854879 - protein, 122 aa, Homo sapiens; identical to SEQ ID NO: 854877

SEQ ID NO: 854880 - protein, 129 aa, Homo sapiens
MQDYNKDDMSYRRISAVEPKTALPFNRFLPNKSRQPSYVPAPLRKKKPDKHEDNRRSWASPVYTEADGTFSRSKSMSDVSAEDVQNLRQLRYEEMQKIKSQLKEQDQKWQDDLAKWKDRRKSYTSDLQK

SEQ ID NO: 854881 - protein, 129 aa, Homo sapiens; identical to SEQ ID NO: 854880

SEQ ID NO: 854882 - protein, 129 aa, Homo sapiens; identical to SEQ ID NO: 854880

SEQ ID NO: 854883 - protein, 236 aa, Homo sapiens
SQRSQKQCMPGHKIARLCMLWRTERLYKPYVFFFKYTYAWVLLLPLLLTDNINVFLKACEQIGLKEAQLFHPGDLQDLSNRVTVKLDSLVSNVNIELLNALRYHMVGRRVLTDELKHGMTLTSMYQNSNIQIHHYPNGIVTVNCARLLKGRHHATNGVVHLIDKVISTITNNIQQIIEIEDTFETLRAAVAASGLNTMLEGNGQYTLLARPMRPLEKIPSESLNRILGDQKALRDC

SEQ ID NO: 854884 - protein, 255 aa, Homo sapiens
AALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQK

SEQ ID NO: 854885 - protein, 472 aa, Homo sapiens
NGYVRGWCRALPLGTRFASRVLPDCPGPRGPWVAFRSLEKARSSRSCRFETLTNCRAQQRELEPRRLRSRSGSRSCGRPACPPRPWGPDARGQPLPSTHPESLSPSLVLAMEGLEEAEANCSVAFAEAQRWVEAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSRSKSMSDVSAEDVQNLRQLRYEEMQKIKSQLKEQDQKWQDDLAKWKDRRKSYTSDLQK

SEQ ID NO: 854886 - protein, 139 aa, Homo sapiens
MQDYNKDDMSYRRISAVEPKTALPFNRFLPNKSRQPSYVPAPLRKKKPDKHEDNRRSWASPVYTEADGTFSRLFQKIYGENGSKSMSDVSAEDVQNLRQLRYEEMQKIKSQLKEQDQKWQDDLAKWKDRRKSYTSDLQK

SEQ ID NO: 854887 - protein, 106 aa, Homo sapiens
PPEIQAKFLCVLERTCPSKEKSNSCRILVPSYRQKKDDMLTRKIQSWKLGTTVPPISFTPGPCSEADLKRWEAIREASRLRHKKRLMVERSECVSARILLVMDGLV

SEQ ID NO: 854888 - protein, 442 aa, Homo sapiens
MAGAATGSRTPGRSELVEGCGWRCPEHGDRVAELFCRRCRRCVCALCPVLGAHRGHPVGLALEAAVHVQKLSQECLKQLAIKKQQHIDNITQIEDATEKLKANAESSKTWLKGKFTELRLLLDEEEALAKKFIDKNTQLTLQVYREQADSCREQLDIMNDLSNRVWSISQEPDPVQRLQAYTATEQEMQQQMSLGELCHPVPLSFEPVKSFFKGLVEAVESTLQTPLDIRLKESINCQLSDPSSTKPGTLLKTSPSPERSLLLKYARTPTLDPDTMHARLRLSADRLTVRCGLLGSLGPVPVLRFDALWQVLARDCFATGRHYWEVDVQEAGAGWWVGAAYASLRRRGASAAARLGCNRQSWCLKRYDLEYWAFHDGQRSRLRPRDDLDRLGVFLDYEAGVLAFYDVTGGMSHLHTFRATFQEPLYPALRLWEGAISIPRLP

SEQ ID NO: 854889 - protein, 442 aa, Homo sapiens; identical to SEQ ID NO: 854888

SEQ ID NO: 854890 - protein, 442 aa, Homo sapiens; identical to SEQ ID NO: 854888

SEQ ID NO: 854891 - protein, 442 aa, Homo sapiens; identical to SEQ ID NO: 854888

SEQ ID NO: 854892 - protein, 442 aa, Homo sapiens; identical to SEQ ID NO: 854888

SEQ ID NO: 854893 - protein, 442 aa, Homo sapiens; identical to SEQ ID NO: 854888

SEQ ID NO: 854894 - protein, 442 aa, Homo sapiens; identical to SEQ ID NO: 854888

SEQ ID NO: 854895 - protein, 442 aa, Homo sapiens; identical to SEQ ID NO: 854888

SEQ ID NO: 854896 - protein, 249 aa, Homo sapiens
MAGAATGSRTPGRSELVEGCGWRCPEHGDRVAELFCRRCRRCVCALCPVLGAHRGHPVGLALEAAVHVQKLSQECLKQLAIKKQQHIDNITQIEDATEKLKANAESSKTWLKGKFTELRLLLDEEEALAKKFIDKNTQLTLQVYREQADSCREQLDIMNDLSNRVWSISQEPDPVQRLQAYTATEQEMQQQMSLGELCHPVPLSFEPVKSFFKGLVEAVESTLQTPLDIRLKETFPDQSRLQCFEGFLS

SEQ ID NO: 854897 - protein, 275 aa, Homo sapiens
RYWNSVIKQEAHPLLAGSLGASHFWWDHLPAWAGRGSTLLVGGCSEARRCSRRAVILLGVGRPAWSRPAHGRGFGFPWEPRPVSRGAGGGGDEWRARRPGAGPLGGRSLSRDAAGAARSMATAWLSSSVAAAAAACARFARCWARTVATLWAWRWRQRCTCRWGRWGRGSPRGSWGSQPRHNGRGGGVPGRGQWRVTTWKPKVPQRASKRSTESSEREPETQGRAKASQSHQLSFRKGGFRSERLGAQAGTQMSLTVSTMADPPHCHWAGRQSAF

SEQ ID NO: 854898 - protein, 392 aa, Homo sapiens
MTLGKLPHLQMPPLEKNTRKLSQECLKQLAIKKQQHIDNITQIEDATEKLKANAESSKTWLKGKFTELRLLLDEEEALAKKFIDKNTQLTLQVYREQADSCREQLDIMNDLSNRVWSISQEPDPVQRLQAYTATEQEMQQQMSLGELCHPVPLSFEPVKSFFKGLVEAVESTLQTPLDIRLKESINCQLSDPSSTKPGTLLKTSPSPERSLLLKYARTPTLDPDTMHARLRLSADRLTVRCGLLGSLGPVPVLRFDALWQVLARDCFATGRHYWEVDVQEAGAGWWVGAAYASLRRRGASAAARLGCNRQSWCLKRYDLEYWAFHDGQRSRLRPRDDLDRLGVFLDYEAGVLAFYDVTGGMSHLHTFRATFQEPLYPALRLWEGAISIPRLP

SEQ ID NO: 854899 - protein, 440 aa, Homo sapiens
RYWNSVIKQEAHPLLAGSLGASHFWWDHLPAWAGRGSTLLVGGCSEARRCSRRAVILLGVGRPAWSRPAHGRGFGFPWEPRPVSRGAGGGGDEWRARRPGAGPLGGRSLSRDAAGAARSMATAWLSSSVAAAAAACARFARCWARTVATLWAWRWRQRCTCRVWSISQEPDPVQRLQAYTATEQEMQQQMSLGELCHPVPLSFEPVKSFFKGLVEAVESTLQTPLDIRLKESINCQLSDPSSTKPGTLLKTSPSPERSLLLKYARTPTLDPDTMHARLRLSADRLTVRCGLLGSLGPVPVLRFDALWQVLARDCFATGRHYWEVDVQEAGAGWWVGAAYASLRRRGASAAARLGCNRQSWCLKRYDLEYWAFHDGQRSRLRPRDDLDRLGVFLDYEAGVLAFYDVTGGMSHLHTFRATFQEPLYPALRLWEGAISIPRLP

SEQ ID NO: 854900 - protein, 476 aa, Homo sapiens
MAGAATGSRTPGRSELVEGCGWRCPEHGDRVAELFCRRCRRCVCALCPVLGAHRGHPVGLALEAAVHVQKLSQECLKQLAIKKQQHIDNITQIEDATEKLKANAESSKTWLKGKFTELRLLLDEEEALAKKFIDKNTQLTLQVYREQADSCREQLDIMNDLSNRVWSISQEPDPVQRLQAYTATEQEMQQQMSLGELCHPVPLSFEPVKSFFKGLVEAVESTLQTPLDIRLKESINCQLSDPSSTKPGTLLKTSPSPERSLLLKYQEMEISTPQKSSSCAFLFTIPKGDATLQTSRTIDARTPTLDPDTMHARLRLSADRLTVRCGLLGSLGPVPVLRFDALWQVLARDCFATGRHYWEVDVQEAGAGWWVGAAYASLRRRGASAAARLGCNRQSWCLKRYDLEYWAFHDGQRSRLRPRDDLDRLGVFLDYEAGVLAFYDVTGGMSHLHTFRATFQEPLYPALRLWEGAISIPRLP

SEQ ID NO: 854901 - protein, 442 aa, Homo sapiens; identical to SEQ ID NO: 854888

SEQ ID NO: 854902 - protein, 442 aa, Homo sapiens; identical to SEQ ID NO: 854888

SEQ ID NO: 854903 - protein, 442 aa, Homo sapiens; identical to SEQ ID NO: 854888

SEQ ID NO: 854904 - protein, 422 aa, Homo sapiens
MTVFFKTLRNHWKKTTAGLCLLTWGGHWLYGKHCDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 854905 - protein, 422 aa, Homo sapiens; identical to SEQ ID NO: 854904

SEQ ID NO: 854906 - protein, 422 aa, Homo sapiens; identical to SEQ ID NO: 854904

SEQ ID NO: 854907 - protein, 214 aa, Homo sapiens
MTVFFKTLRNHWKKTTAGLCLLTWGGHWLYGKHCDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKVLVSWASKNQSSPLFQHS

SEQ ID NO: 854908 - protein, 210 aa, Homo sapiens
EKDSEFQRCWRQVQSIGSKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 854909 - protein, 102 aa, Homo sapiens
MREDCEGEGEEAELAGLSYRLSLRQIPFKITYTMPTHPMERDQCFSRLQNSYEKSMNEDHKKEGFLISYCILQGGKISAFGKNITDGSKHQHKDHSSHTTHR

SEQ ID NO: 854910 - protein, 409 aa, Homo sapiens
MTVFFKTLRNHWKKTTAGLCLLTWGGHWLYGKHCDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDMRKLVQRKAREGCLPRNSALHEV

SEQ ID NO: 854911 - protein, 113 aa, Homo sapiens
MTVFFKTLRNHWKKTTAGLCLLTWGGHWLYGKHCDNLLRRAACQEAQHYQDESRWEPTLSELQEVNHLVKSSSDAHPYRLFVSGLVPRTQNWTGRSSGNLFVSAVVFVDLSNP

SEQ ID NO: 854912 - protein, 422 aa, Homo sapiens; identical to SEQ ID NO: 854904

SEQ ID NO: 854913 - protein, 422 aa, Homo sapiens; identical to SEQ ID NO: 854904

SEQ ID NO: 854914 - protein, 213 aa, Homo sapiens
MPVVLEKMLGQVQKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 854915 - protein, 78 aa, Homo sapiens
LKKKKAVPSGIPGLHVEGTECLQASQCTLLIPEGAGGSFSIDSEEYEAMPVEVKLLPRKLQFFCDPRKREQMLTSPTQ

SEQ ID NO: 854916 - protein, 434 aa, Homo sapiens
MTVFFKTLRNHWKKTTAGLCLLTWGGHWLYGKHCDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLIYNIILRAHYCLCPTLS

SEQ ID NO: 854917 - protein, 173 aa, Homo sapiens [sequence omitted]

SEQ ID NO: 854918 - protein, 292 aa, Homo sapiens
AGTSLVRRLAAAAAAAAGARAPAAEGGRAGAGEGGGPVRDDSPDGVSPPSGAGFGLGGAGYSPSMTMGDKKSPTRPKRQAKPAADEGFWDCSVCTFRNSAEAFKCSICDVRKGTSTRKPRINSQLVAQQVAQQYATPPPPKKEKKEKVEKQDKEKPEKDKEISPSVTKKNTNKKTKPKSDILKDPPSEANSIQSANATTKTSETNHTSRPRLKNVDRSTAQQLAVTVGNVTVIITDFKEKTRSSSTSSSTVTSSAGSEQQNQSSSGSESTDKGSSRSSTPKGDMSAVNDESF

SEQ ID NO: 854919 - protein, 194 aa, Homo sapiens
PSCLGSSLSPVTSQMCDSGKPRINSQLVAQQVAQQYATPPPPKKEKKEKVEKQDKEKPEKDKEISPSVTKKNTNKKTKPKSDILKDPPSEANSIQSANATTKTSETNHTSRPRLKNVDRSTAQQLAVTVGNVTVIITDFKEKTRSSSTSSSTVTSSAGSEQQNQSSSGSESTDKGSSRSSTPKGDMSAVNDESF

SEQ ID NO: 854920 - protein, 292 aa, Homo sapiens; identical to SEQ ID NO: 854918

SEQ ID NO: 854921 - protein, 292 aa, Homo sapiens; identical to SEQ ID NO: 854918

SEQ ID NO: 854922 - protein, 69 aa, Homo sapiens
HVAGPEGSDGEELRILVCTCSIHTEPGSKQQHLHTALRAAIRSEITAGYIHVTVYIKGYLKPIHGNAGA

SEQ ID NO: 854923 - protein, 292 aa, Homo sapiens; identical to SEQ ID NO: 854918

SEQ ID NO: 854924 - protein, 292 aa, Homo sapiens; identical to SEQ ID NO: 854918

SEQ ID NO: 854925 - protein, 292 aa, Homo sapiens; identical to SEQ ID NO: 854918

SEQ ID NO: 854926 - protein, 255 aa, Homo sapiens
MKGRLITIILLVTSIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIR

SEQ ID NO: 854927 - protein, 523 aa, Homo sapiens
GTTPARARPLVPARGGYYRSFSVRPWAMASLRNANPRLKNYFKENYIPQVCEALLCGILVTCPEDPLRYLEGMIMVIIKSGLQNLLWDMCITPSMKPNIRRLSETYLEQLFELDDQLMTPELMIKACSFYTGHLVKTHFCTWRDIARTNENVVLAEKMNRAVTCYNFRLQKSVFHHWHSYMEDQKEKLKNMLLRIQQIIYCHKLTIILTKWRNTARHKSKKKEDELILKHELQLKTWNNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIR

SEQ ID NO: 854928 - protein, 406 aa, Homo sapiens
MTPELMIKACSFYTGHLVKTHFCTWRDIARTNENVVLAEKMNRAVTCYNFRLQKSVFHHWHSYMEDQKEKLKNMLLRIQQIIYCHKLTIILTKWRNTARHKSKKKEDELILKHELQLKTWNTRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIR

SEQ ID NO: 854929 - protein, 147 aa, Homo sapiens
MGTPASVVSEPPPWQAPIEARGRKQASANIFQDAELLQIQALFQRSGDQLAEERAQIIWECAGDHRVAEALKRLRRKRPPRQKPLGHSLHHCSRLRILEPHSALANPQSATETASSEQYLHSRKKSARIRRNWRKSGPTSYLHQIRH

SEQ ID NO: 854930 - protein, 147 aa, Homo sapiens; identical to SEQ ID NO: 854929

SEQ ID NO: 854931 - protein, 147 aa, Homo sapiens; identical to SEQ ID NO: 854929

SEQ ID NO: 854932 - protein, 597 aa, Homo sapiens [sequence omitted]

SEQ ID NO: 854933 - protein, 668 aa, Homo sapiens [sequence omitted]

SEQ ID NO: 854934 - protein, 668 aa, Homo sapiens [sequence omitted]

SEQ ID NO: 854935 - protein, 597 aa, Homo sapiens [sequence omitted]

SEQ ID NO: 854936 - protein, 597 aa, Homo sapiens [sequence omitted]

SEQ ID NO: 854937 - protein, 568 aa, Homo sapiens
MRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRAWTFLHSSALINYVCCLNN

SEQ ID NO: 854938 - protein, 597 aa, Homo sapiens [sequence omitted]

SEQ ID NO: 854939 - protein, 647 aa, Homo sapiens
MRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAERWNNTPMDEALHFGHHDVFKILQEYQVQYTPQGDSDNGKENQTVHKNLDGLL

SEQ ID NO: 854940 - protein, 174 aa, Homo sapiens
MGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 854941 - protein, 668 aa, Homo sapiens [sequence omitted]

SEQ ID NO: 854942 - protein, 597 aa, Homo sapiens [sequence omitted]

SEQ ID NO: 854943 - protein, 567 aa, Homo sapiens
MRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRGKQNSYLDKYIKFLRREK

SEQ ID NO: 854944 - protein, 201 aa, Homo sapiens [sequence omitted]

SEQ ID NO: 854945 - protein, 417 aa, Homo sapiens
MRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQVI

SEQ ID NO: 854946 - protein, 597 aa, Homo sapiens [sequence omitted]

SEQ ID NO: 854947 - protein, 597 aa, Homo sapiens [sequence omitted]

SEQ ID NO: 854948 - protein, 359 aa, Homo sapiens
MRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVSV

SEQ ID NO: 854949 - protein, 240 aa, Homo sapiens
MQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRHSFGPLDYESLQQELALKETVWKKVSPESNEDISTTVVYRMESLGEKS

SEQ ID NO: 854950 - protein, 330 aa, Homo sapiens
MSLIFLQQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 854951 - protein, 69 aa, Homo sapiens
RTWAYALFLTLTTKLTNTNISDAQEIETVCTILPAIILVLIALPSLRILYNAQVRKPGTSFGETTANVP

SEQ ID NO: 854952 - protein, 168 aa, Homo sapiens
MRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITVSFYIFLS

SEQ ID NO: 854953 - protein, 487 aa, Homo sapiens
MRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVSNCLILFSLARN

SEQ ID NO: 854954 - protein, 333 aa, Homo sapiens
MRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDGKNYINIG

SEQ ID NO: 854955 - protein, 833 aa, Homo sapiens
MATLDRKVPSPEAFLGKPWSSWIDAAKLHCSDNVDLEEAGKEGGKSREVMRLNKEDMHLFGHYPAHDDFYLVVCSACNQVVKPQVFQSHCERRHGSMCRPSPSPVSPASNPRTSLVQVKTKACLSGHHSASSTSKPFKTPKDNLLTSSSKQHTVFPAKGSRDKPCVPVPVVSLEKIPNLVKADGANVKMNSTTTTAVSASSTSSSAVSTPPLIKPVLMSKSVPPSPEKILNGKGILPTTIDKKHQNGTKNSNKPYRRLSEREFDPNKHCGVLDPETKKPCTRSLTCKTHSLSHRRAVPGRKKQFDLLLAEHKAKSREKEVKDKEHLLTSTREILPSQSGPAQDSLLGSSGSSGPEPKVASPAKSRPPNSVLPRPSSANSISSSTSSNHSGHTPEPPLPPVGGDLASRLSSDEGEMDGADESEKLDCQFSTHHPRPLAFCSFGSRLMGRGYYVFDRRWDRFRFALNSMVEKHLNSQMWKKIPPAADSPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVGKNSSLALSQSSPSSISSPGHSRQNTNRTGRIRTLP

SEQ ID NO: 854956 - protein, 100 aa, Homo sapiens
LFQNTLVFISPTDMHLFGHYPAHDDFYLVVCSACNQVVKPQVFQSHCGKWTPAPSATSAAAALGTVAFPWAPRQGLAMSCLSLRLWVKSSWAAASARRLF

SEQ ID NO: 854957 - protein, 792 aa, Homo sapiens
MATLDRKVPSPEAFLGKPWSSWIDAAKLHCSDNVDLEEAGKEGGKSREVMRLNKEDMHLFGHYPAHDDFYLVVCSACNQVVKPQVFQSHCERRHGSMCRPSPSPVSPASNPRTSLVQVKTKACLSGHHSASSTSKPFKTPKDNLLTSSSKQHTVFPAKGSRDKPCVPVPVVSLEKIPNLVKADGANVKMNSTTTTAVSASSTSSSAVSTPPLIKPVLMSKSVPPSPEKILNGKGILPTTIDKKHQNGTKNSNKPYRRLSEREFDPNKHCGVLDPETKKPCTRSLTCKTHSLSHRRAVPGRKKQFDLLLAEHKAKSREKEVKDKEHLLTSTREILPSQSGPAQDSLLGSSGSSGPEPKVASPAKSRPPNSVLPRPSSANSISSSTSSNHSGHTPEPPLPPVGGDLASRLSSDEGEMDGADESEKLDCQFSTHHPRPLAEDPSCGRYPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVGKNSSLALSQSSPSSISSPGHSRQNTNRTGRIRTLP

SEQ ID NO: 854958 - protein, 759 aa, Homo sapiens
MNSTTTTAVSASSTSSSAVSTPPLIKPVLMSKSVPPSPEKILNGKGILPTTIDKKHQNGTKNSNKPYRRLSEREFDPNKHCGVLDPETKKPCTRSLTCKTHSLSHRRAVPGRKKQFDLLLAEHKAKSREKEVKDKEHLLTSTREILPSQSGPAQDSLLGSSGSSGPEPKVASPAKSRPPNSVLPRPSSANSISSSTSSNHSGHTPEPPLPPVGGDLASRLSSDEGEMDGADESEKLDCQFSTHHPRPLAFCSFGSRLMGRGYYVFDRRWDRFRFALNSMVEKHLNSQMWKHRNPSHRASGPSPLFRTCLTNLLSLSNIGAAWVSTLESVAPRYPLNLAAQTPGPGGPEPGGMAADGGVEDIRKKRNGQDSFFFNKHLTLHQEPPTQYSLSARKIPPAADSPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVRDLLAPPSPALGGRGSWAAPLLSRAAPTGNTSLIPVLVFPEGSFHPLL

SEQ ID NO: 854959 - protein, 118 aa, Homo sapiens
MATLDRKVPSPEAFLGKPWSSWIDAAKLHCSDNVDLEEAGKEGGKSREVMRLNKEDMHLFGHYPAHDDFYLVVCSACNQVVKPQVFQSHCAGPATVPPSGSSFSFSDSWARCVHLAPC

SEQ ID NO: 854960 - protein, 130 aa, Homo sapiens
MATLDRKVPSPEAFLGKPWSSWIDAAKLHCSDNVDLEEAGKEGGKSREVMRLNKEDMHLFGHYPAHDDFYLVVCSACNQVVKPQVFQSHCALKEKTTVRQPVNLKQRKWVAGAMREASLKITLEPDRGRL

SEQ ID NO: 854961 - protein, 161 aa, Homo sapiens
RYAPRGEPGGPGALTFEFCTPRSLRWEGSSSRSKLTCVSERIYPLVSAPRATTAESPWSKVLQNTQCRNVPKMTSERSRIPCLSAAAAEGTGKKQQEGRAMATLDRKVPSPEAFLGKPWSSWIDAAKLHCSDNVDLEEAGKEGGKSREVMRLNKEAWKYGT

SEQ ID NO: 854962 - protein, 126 aa, Homo sapiens
MNSTTTTAVSASSTSSSAVSTPPLIKPVLMSKSVPPSPEKILNGKGILPTTIDKKHQNGTKNSNKPYRRLSEREFDPNKHCGVLDPETKKPCTRSLTCKTHSVKPRKAVQGGKAIYFSGDKSKSGK

SEQ ID NO: 854963 - protein, 947 aa, Homo sapiens
MATLDRKVPSPEAFLGKPWSSWIDAAKLHCSDNVDLEEAGKEGGKSREVMRLNKEDMHLFGHYPAHDDFYLVVCSACNQVVKPQVFQSHCERRHGSMCRPSPSPVSPASNPRTSLVQVKTKACLSGHHSASSTSKPFKTPKDNLLTSSSKQHTVFPAKGSRDKPCVPVPVVSLEKIPNLVKADGANVKMNSTTTTAVSASSTSSSAVSTPPLIKPVLMSKSVPPSPEKILNGKGILPTTIDKKHQNGTKNSNKPYRRLSEREFDPNKHCGVLDPETKKPCTRSLTCKTHSLSHRRAVPGRKKQFDLLLAEHKAKSREKEVKDKEHLLTSTREILPSQSGPAQDSLLGSSGSSGPEPKVASPAKSRPPNSVLPRPSSANSISSSTSSNHSGHTPEPPLPPVGGDLASRLSSDEGEMDGADESEKLDCQFSTHHPRPLAFCSFGSRLMGRGYYVFDRRWDRFRFALNSMVEKHLNSQMWKHRNPSHRASGPSPLFRTCLTNLLSLSNIGAAWVSTLESVAPRYPLNLAAQTPGPGGPEPGGMAADGGVEDIRKKRNGQDSFFFNKHLTLHQEPPTQYSLSARKIPPAADSPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVRDLLAPPSPALGGRGSWAAPLLSRAAPTGNTSLIPVLVFPEGSFHPLL

SEQ ID NO: 854964 - protein, 478 aa, Homo sapiens [sequence omitted]

SEQ ID NO: 854965 - protein, 146 aa, Homo sapiens
MTSERSRIPCLSAAAAEGTGKKQQEGRAMATLDRKVPSPEAFLGKPWSSWIDAAKLHCSDNVDLEEAGKEGGKSREVMRLNKEDMHLFGHYPAHDDFYLVVCSACNQVVKPQVFQSHCGRKQDNRRNEGISRSGPESSQAIEKHQV

SEQ ID NO: 854966 - protein, 128 aa, Homo sapiens
MTGYTPDEKLRLQQLRELRRRWLKDQELSPREPVLPPQKMGPMEKFWNKFLENKSPWRKMVHGVYKKSIFVFTHVLVPVWIIHYYMKYHVSEKPYGIVEKKSRIFPGDTILETGEVIPPMKEFPDQHH

SEQ ID NO: 854967 - protein, 128 aa, Homo sapiens; identical to SEQ ID NO: 854966

SEQ ID NO: 854968 - protein, 90 aa, Homo sapiens
SAATGDLATDFPGCLNSARGILVHGVYKKSIFVFTHVLVPVWIIHYYMKYHVSEKPYGIVEKKSRIFPGDTILETGEVIPPMKEFPDQHH

SEQ ID NO: 854969 - protein, 78 aa, Homo sapiens
RPHNYEYSLSPPGPNLVGYSGGGRRENWRWRPLCMPTHCFPREESGALAEAEPGCDVITARGARRSRKVALQSGSALK

SEQ ID NO: 854970 - protein, 128 aa, Homo sapiens; identical to SEQ ID NO: 854966

SEQ ID NO: 854971 - protein, 128 aa, Homo sapiens; identical to SEQ ID NO: 854966

SEQ ID NO: 854972 - protein, 128 aa, Homo sapiens; identical to SEQ ID NO: 854966

SEQ ID NO: 854973 - protein, 128 aa, Homo sapiens; identical to SEQ ID NO: 854966

SEQ ID NO: 854974 - protein, 78 aa, Homo sapiens; identical to SEQ ID NO: 854969

SEQ ID NO: 854975 - protein, 138 aa, Homo sapiens
MTGYTPDEKLRLQQLRELRRRWLKDQELSPREPVLPPQKMGPMEKFWNKFLENKSPWRKMVSDRPLRSPPTHPTAAGSLNTERPLPAATPRTDNAQCSGTLASPESPPGVSGGRSPGICMALRESCLLLSSTVDGGEF

SEQ ID NO: 854976 - protein, 113 aa, Homo sapiens
MTGYTPDEKLRLQQLRELRRRWLKDQELSPREPVLPPQKMGPMEKFWNKFLENKSPWRKMVHGVYKKSIFVFTHVLVPVWIIHYYMKYHVSGDTILETGEVIPPMKEFPDQHH

SEQ ID NO: 854977 - protein, 569 aa, Homo sapiens
VLGVLPWSAAAGLRAGVRVPRSPGPSRRMPARSGAQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGTGMATLRRTPGDPGIVWNQCGTFQRPPEKRRPTGPKGPANLGAPTRGGRGHNNSVTRAGARTNCRGPTPHKCSKGRREQRPPSRERGRAHLINPDKKTLHTFLLSLTYTTNHTYTRPHTTTLTSLTSITHHHRHPTPITHPTPRHTHLSGFTIAPITKTSTISTTKATHSRHAHTRPHSHPQRAKGTYDGAAQRTRGERSGGRRRREMTQGCADTRGGEGSNGRTTENQADERDYNRRRKRQHAERPRADGTAAKHACGAKWTKHTDDRDQTTKSAATQRTDGRRRDEERESRQSRRQKEGDTRRAERGTAWGRDGENEAKHGGQRRKDATTTTPHTTENTEPTPTRRRRDQRAERQQPESTRNRRTPPTHT

SEQ ID NO: 854978 - protein, 298 aa, Homo sapiens
MVTPALQMKKPKQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 854979 - protein, 281 aa, Homo sapiens
MGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 854980 - protein, 238 aa, Homo sapiens
VLGVLPWSAAAGLRAGVRVPRSPGPSRRMPARSGAQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVGRGLRLAASTGAPGRSGDHASASQHPPERHRQPCPQGPRALQWPLQAVPGPGHQQEL

SEQ ID NO: 854981 - protein, 321 aa, Homo sapiens
VLGVLPWSAAAGLRAGVRVPRSPGPSRRMPARSGAQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 854982 - protein, 321 aa, Homo sapiens; identical to SEQ ID NO: 854981

SEQ ID NO: 854983 - protein, 991 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 854984 - protein, 435 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGRWGRGHGKSLRAAWCSQVVSRHAEL

SEQ ID NO: 854985 - protein, 187 aa, Homo sapiens
MGSPRPPGMREPPGPSAVMPALPSTSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 854986 - protein, 686 aa, Homo sapiens
MEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 854987 - protein, 823 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 854988 - protein, 589 aa, Homo sapiens
LCGAACSRCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 854989 - protein, 991 aa, Homo sapiens; identical to SEQ ID NO: 854983

SEQ ID NO: 854990 - protein, 410 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELG

SEQ ID NO: 854991 - protein, 1020 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHQQVRPRMTHARIWGRTAALPSQQLVTSGATQPCQVE

SEQ ID NO: 854992 - protein, 294 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGVCRPLEYCQVYGWVLPGVWPGWQGWEAFLVPSLLLQE

SEQ ID NO: 854993 - protein, 385 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNKVVLLWGMQACTQPFSKKK

SEQ ID NO: 854994 - protein, 410 aa, Homo sapiens; identical to SEQ ID NO: 854990

SEQ ID NO: 854995 - protein, 991 aa, Homo sapiens; identical to SEQ ID NO: 854983

SEQ ID NO: 854996 - protein, 1104 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEWFHDHWAEEHSKLSFPWRLQDPVNPGLFGPPLPRLYLSYSRGLPLQPHQGQAWLQLRCYQQLLRDSKPQGAQRALIRIPVPKAYPTRPGVPQELSREKPRPPDTLCLLPCTHRADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 854997 - protein, 509 aa, Homo sapiens
DSRGSPIGYGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 854998 - protein, 1012 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPRPPGMREPPGPSAVMPALPSTSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 854999 - protein, 991 aa, Homo sapiens; identical to SEQ ID NO: 854983

SEQ ID NO: 855000 - protein, 698 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSVSCGPVASRPVTRKGFTSPLPSGVHLLPRPGSPPGSCLPLPSHTPESPV

SEQ ID NO: 855001 - protein, 329 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVR

SEQ ID NO: 855002 - protein, 292 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAG

SEQ ID NO: 855003 - protein, 352 aa, Homo sapiens
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 855004 - protein, 383 aa, Homo sapiens
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 855005 - protein, 758 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKHPTPGSSDPLIQPSSPAVCPEPPSSPKHVSSVTSRTGSSGAKEMKLKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 855006 - protein, 352 aa, Homo sapiens; identical to SEQ ID NO: 855003

SEQ ID NO: 855007 - protein, 441 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 855008 - protein, 383 aa, Homo sapiens; identical to SEQ ID NO: 855004

SEQ ID NO: 855009 - protein, 412 aa, Homo sapiens
MAEPRQEFEVMEDHAGTYGLGDRKDQGGYTMHQDQEGDTDAGLKESPLQTPTEDGSEEPGSETSDAKSTPTAEAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 855010 - protein, 383 aa, Homo sapiens; identical to SEQ ID NO: 855004

SEQ ID NO: 855011 - protein, 653 aa, Homo sapiens
EISAHVQPGPCGEASGVSGPCLGEKEPEAPVPLTASLPQHRPVCPAPPPTGGPQEPSLEWGQKGGDWAEKGPAFPKPATTAYLHTEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 855012 - protein, 352 aa, Homo sapiens; identical to SEQ ID NO: 855003

SEQ ID NO: 855013 - protein, 133 aa, Homo sapiens
MAEPRQEFEVMEDHAGTYGLGDRKDQGGYTMHQDQEGDTDAGLKESPLQTPTEDGSEEPGSETSDAKSTPTAEAEEAGIGDTPSLEDEAAGHVTQARMVSKSKDGTGSDDKKAKGADGKTKIATPRGLVRGTE

SEQ ID NO: 855014 - protein, 165 aa, Homo sapiens
MVFPSSSLSGVKGWQRQCSVQFLTQAGPGYRSSALCVTARQLTQCRGSDRVRGSLLTPSVSRTLAFSWTCCSSEPFCHCHHLVRNSGRICTQSCAQAVEPTLAQRYCHMTRHCHHWASWVAQCRLDGPGGCLCHASASDGSPVSPLPALPCPQQLPGDSQWPGCF

SEQ ID NO: 855015 - protein, 352 aa, Homo sapiens; identical to SEQ ID NO: 855003

SEQ ID NO: 855016 - protein, 352 aa, Homo sapiens; identical to SEQ ID NO: 855003

SEQ ID NO: 855017 - protein, 352 aa, Homo sapiens; identical to SEQ ID NO: 855003

SEQ ID NO: 855018 - protein, 623 aa, Homo sapiens
MFKGKCPKVQRAWFLVNNNCLAFTPLHLLTHTPAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 855019 - protein, 352 aa, Homo sapiens; identical to SEQ ID NO: 855003

SEQ ID NO: 855020 - protein, 1817 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRPGHLASEIIREDKSVSFSCQ

SEQ ID NO: 855021 - protein, 1770 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDTSMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRSKLSRRCPSQSKY

SEQ ID NO: 855022 - protein, 579 aa, Homo sapiens [sequence omitted]

SEQ ID NO: 855023 - protein, 593 aa, Homo sapiens [sequence omitted]

SEQ ID NO: 855024 - protein, 1864 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVSRGRVVQMQELSDKIAKVSVFLPAAACDHSFSLFSPEVLTSFVFAIAVVLIFQVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRSKLSRRCPSQSKY

SEQ ID NO: 855025 - protein, 1193 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDADSDSGDDSDKRSCEESWKLITSLREKLPPSKLQTIVKKCGLPSSGKKREPIKMYQIPQRRRLSKDSKWVTISDLKIQAVKEICYEVALNDFRHSRQEIEALAIVKMKELCAMYGKKDPNERDSWRAVARDVWDTVGVGDEKIEDVMATGKGSTDVDDLKVHIDKLEDILQEVKKQNNMKDEEIKVLRNKMLKMEKVLPLIGSQEQKSPGSHKAKEPVGAGVSSTSENNVSKGDNGELAKEERVSQLMNGDPAFRRGRLRWMRQEQIRFKNLQQQEITKQLRRQNVPHRFIPPENRKPRFPFKSNPKHRNSWSPGTHIIITEDEVIELRIPKDDEARKGNKEESQEKGGKGAFKDPQFPWGSQGMRSQDHIQVSKQHINNQQQPPQLRWRSNSLNNGQPKSTRCQASASAESLNSHSGHPTADVQTFQAKRHIHQHRQSYCNYNTGGQLEGNAATSYQKQTDKPSHCSQFVTPPRMRRQFSAPNLKAGRETTV

SEQ ID NO: 855026 - protein, 1303 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGRSRGQEIETILANTVKPRLY

SEQ ID NO: 855027 - protein, 923 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGRAFVYLSNLLYPVPLIHRVAIVSEKGEVLGDNIIEILE

SEQ ID NO: 855028 - protein, 557 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDTSMGSLTSSPSSCSLSSQVGLTSVTSIQERIMSTPGGEEAIERLKESEKIIAELNETWEEKLRKTEAIRMEREALLAEMGVAIREDGGTLGVFSPKKVGNNAVKPNQTETLFVCLCYWGTSCLSGPTLPLIILILALISDISDFILEHGLIVQRQPISKMPILFTVYKRK

SEQ ID NO: 855029 - protein, 440 aa, Homo sapiens [sequence omitted]

SEQ ID NO: 855030 - protein, 1770 aa, Homo sapiens; identical to SEQ ID NO: 855021

SEQ ID NO: 855031 - protein, 1770 aa, Homo sapiens; identical to SEQ ID NO: 855021

SEQ ID NO: 855032 - protein, 1810 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRSKLSRRCPSQSKY

SEQ ID NO: 855033 - protein, 1304 aa, Homo sapiens
MSGASVKVAVRVRPFNSRETSKESKCIIQMQGNSTSIINPKNPKEAPKSFSFDYSYWSHTSAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRSKLSRRCPSQSKY

SEQ ID NO: 855034 - protein, 867 aa, Homo sapiens [sequence omitted]

SEQ ID NO: 855035 - protein, 593 aa, Homo sapiens [sequence omitted]

SEQ ID NO: 855036 - protein, 1153 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDTSMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDADSDSGDDSDKRSCEESWKLITSLREKLPPSKLQTIVKKCGLPSSGKKREPIKMYQIPQRRRLSKDSKWVTISDLKIQAVKEICYEVALNDFRHSRQEIEALAIVKMKELCAMYGKKDPNERDSWRAVARDVWDTVGVGDEKIEDVMATGKGSTDVDDLKVHIDKLEDILQEVKKQNNMKDEEIKVLRNKMLKMEKVLPLIGSQEQKSPGSHKAKEPVGAGVSSTSENNVSKGDNGELAKEERVSQLMNGDPAFRRGRLRWMRQEQIRFKNLQQQEITKQLRRQNVPHRFIPPENRKPRFPFKSNPKHRNSWSPGTHIIITEDEVIELRIPKDDEARKGNKEESQEKGGKGAFKDPQFPWGSQGMRSQDHIQVSKQHINNQQQPPQLRWRSNSLNNGQPKSTRCQASASAESLNSHSGHPTADVQTFQAKRHIHQHRQSYCNYNTGGQLEGNAATSYQKQTDKPSHCSQFVTPPRMRRQFSAPNLKAGRETTV

SEQ ID NO: 855037 - protein, 1810 aa, Homo sapiens; identical to SEQ ID NO: 855032

SEQ ID NO: 855038 - protein, 1112 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPSRGFLVSLTSRMKPWTLAVVVTVLKYGVYGVSPFRCSEFLPSGGYVVLLTSGVKLQTYTVSVTALKGGTQVVRPSRWVHGLADFRNEAADLRGECYSS

SEQ ID NO: 855039 - protein, 76 aa, Homo sapiens
KGYLHFKEPLYSNWAKHFVVVRRPYVFIYNSDKDPVERGIINLSTAQVEYSEDQQAMVKVRPALPWFLIATCALLF

SEQ ID NO: 855040 - protein, 354 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 855041 - protein, 208 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVTEPYTEHNLTLAT

SEQ ID NO: 855042 - protein, 327 aa, Homo sapiens
MRLAVLFSGALLGLLAESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 855043 - protein, 174 aa, Homo sapiens [sequence omitted]

SEQ ID NO: 855044 - protein, 240 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQAPSQQKSMYYT

SEQ ID NO: 855045 - protein, 128 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTAMSAQVDNLLLEVLHESKAEGP

SEQ ID NO: 855046 - protein, 276 aa, Homo sapiens
MMYEVQSAGVVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 855047 - protein, 174 aa, Homo sapiens [sequence omitted]

SEQ ID NO: 855048 - protein, 193 aa, Homo sapiens
AVGVAAVGCQPGWESGGSWLGCWGSVVVVAMFFSEARARSRTWEASPSEHRKWVEVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFREVDRDSDGHVSFRDFEYALNYGQKEA

SEQ ID NO: 855049 - protein, 172 aa, Homo sapiens
AVGVAAVGCQPGWESGGSWLGCWGSVVVVAMFFSEARARSRTWEASPSEHRKWVEVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFRGIFSA

SEQ ID NO: 855050 - protein, 233 aa, Homo sapiens
AVGVAAVGCQPGWESGGSWLGCWGSVVVVAMFFSEARARSRTWEASPSEHRKWVEVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFRSLHVNGSIMPPSKKPESSGISVSSGLSQCYGGSGFSKALQEDDDLDFSLPDIRLEEGAMEDEELTN

SEQ ID NO: 855051 - protein, 193 aa, Homo sapiens; identical to SEQ ID NO: 855048

SEQ ID NO: 855052 - protein, 71 aa, Homo sapiens
RSSNIPEVFGFIEDITESTSILEELVPKQHYNSSFVLSAEISVIFITCFKYRGHAHRGSGKRRKLNDIGTK

SEQ ID NO: 855053 - protein, 193 aa, Homo sapiens; identical to SEQ ID NO: 855048

SEQ ID NO: 855054 - protein, 139 aa, Homo sapiens
MVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFREVDRDSDGHVSFRDFEYALNYGQKEA

SEQ ID NO: 855055 - protein, 191 aa, Homo sapiens
AVGVAAVGCQPGWESGGSWLGCWGSVVVVAMFFSEARARSRTWEASPSEHRKWVEVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFRNLEVIPSSFLFLTLHIQAVNKSRL

SEQ ID NO: 855056 - protein, 71 aa, Homo sapiens; identical to SEQ ID NO: 855052

SEQ ID NO: 855057 - protein, 169 aa, Homo sapiens
AVGVAAVGCQPGWESGGSWLGCWGSVVVVAMFFSEARARSRTWEASPSEHRKWVEVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFSDL

SEQ ID NO: 855058 - protein, 359 aa, Homo sapiens
MPLELELCPGRWVGGQHPCFIIAEIGQNHQGDLDVAKRMIRMAKECGADCAKFQKSELEFKFNRKALERPYTSKHSWGKTYGEHKRHLEFSHDQYRELQRYAEEVGIFFTASGMDEMAVEFLHELNVPFFKVGSGDTNNFPYLEKTAKKGRPMVISSGMQSMDTMKQVYQIVKPLNPNFCFLQCTSAYPLQPEDVNLRVISEYQKLFPDIPIGYSGHETGIAISVAAVALGAKVLERHITLDKTWKGSDHSASLEPGELAELVRSVRLVERALGSPTKQLLPCEMACNEKLGKSVVAKVKIPEGTILTMDMLTVKVGEPKGYPPEDIFNLVGKKVLVTVEEDDTIMEELVDNHGKKIKS

SEQ ID NO: 855059 - protein, 359 aa, Homo sapiens; identical to SEQ ID NO: 855058

SEQ ID NO: 855060 - protein, 320 aa, Homo sapiens [sequence omitted]

SEQ ID NO: 855061 - protein, 283 aa, Homo sapiens
MPLELELCPGRWVGGQHPCFIIAEIGQNHQGDLDVAKRMIRMAKECGADCAKFQKSELEFKFNRKALERPYTSKHSWGKTYGEHKRHLEFSHDQYRELQRYAEEVGIFFTASGMDEMAVEFLHELNVPFFKVGSGDTNNFPYLEKTAKKGRPMVISSGMQSMDTMKQVYQIVKPLNPNFCFLQCTSAYPLQPEDVNLRVISEYQKLFPDIPIGYSGHETGIAISVAAVALGAKVLERHITLDKTWKGSDHSASLEPGELAELVRSVRLVERAPKAILLKTSLI

SEQ ID NO: 855062 - protein, 232 aa, Homo sapiens
MCWGESEPPKEKVLMVLVLDYSGRPMVISSGMQSMDTMKQVYQIVKPLNPNFCFLQCTSAYPLQPEDVNLRVISEYQKLFPDIPIGYSGHETGIAISVAAVALGAKVLERHITLDKTWKGSDHSASLEPGELAELVRSVRLVERALGSPTKQLLPCEMACNEKLGKSVVAKVKIPEGTILTMDMLTVKVGEPKGYPPEDIFNLVGKKVLVTVEEDDTIMEELVDNHGKKIKS

SEQ ID NO: 855063 - protein, 160 aa, Homo sapiens
MPLELELCPGRWVGGQHPCFIIAEIGQNHQGDLDVAKRMIRMAKECGADCAKFQKSELEFKFNRKALERPYTSKHSWGKTYGEHKRHLEFSHDQYRELQRYAEEVGIFFTASGMDEMAVEFLHELNVPFFKVGSGDTNNFPYLEKTAKKGRPMVISSGMQ

SEQ ID NO: 855064 - protein, 127 aa, Homo sapiens
MPLELELCPGRWVGGQHPCFIIAEIGQNHQGDLDVAKRMIRMAKECGADCAKFQKSELEFKFNRKALERPYTSKHSWGKTYGEHKRHLEFSHDQYRELQRYAEEVGIFFTASGMDEVSPLLLCHLSL

SEQ ID NO: 855065 - protein, 112 aa, Homo sapiens
MCWGESEPPKEKVLMVLVLDYSGRPMVISSGMQSMDTMKQVYQIVKPLNPNFCFLQCTSAYPLQPEDVNLRVISVSRREGVPFLGHLLWGRRSLFYNQNSNKHGILYNLNIL

SEQ ID NO: 855066 - protein, 355 aa, Homo sapiens
MPLELELCPGRWVGGQHPCFIIAEIGQNHQGDLDVAKRMIRMAKECGADCAKFQKSELEFKFNRKALERPYTSKHSWGKTYGEHKRHLEFSHDQYRELQRYAEEVGIFFTASGMDEMAVEFLHELNVPFFKVGSGDTNNFPYLEKTAKKGRPMVISSGMQSMDTMKQVYQIVKPLNPNFCFLQCTSAYPLQPEDVNLRVISEYQKLFPDIPIGYSGHETGIAISVAAVALGAKVLERHITLDKTWKGSDHSASLEPGELAELVRSVRLVERALGSPTKQLLPCEMACNEKLGKSVVAKVKIPEGTILTMDMLTVKVGEPKGYPPEDIFNLVGKKVLVTVEEDDTIMEELVDNHGT

SEQ ID NO: 855067 - protein, 243 aa, Homo sapiens
MAVEFLHELNVPFFKVGSGDTNNFPYLEKTAKKGRPMVISSGMQSMDTMKQVYQIVKPLNPNFCFLQCTSAYPLQPEDVNLRVISEYQKLFPDIPIGYSGHETGIAISVAAVALGAKVLERHITLDKTWKGSDHSASLEPGELAELVRSVRLVERALGSPTKQLLPCEMACNEKLGKSVVAKVKIPEGTILTMDMLTVKVGEPKGYPPEDIFNLVGKKVLVTVEEDDTIMEELVDNHGKKIKS

SEQ ID NO: 855068 - protein, 274 aa, Homo sapiens
MPLELELCPGRWVGGQHPCFIIAEIGQNHQGDLDVAKRMIRMAKECGADCAKFQKSELEFKFNRKALERPYTSKHSWGKTYGEHKRHLEFSHDQYRELQRYAEEVGIFFTASGMDEEYQKLFPDIPIGYSGHETGIAISVAAVALGAKVLERHITLDKTWKGSDHSASLEPGELAELVRSVRLVERALGSPTKQLLPCEMACNEKLGKSVVAKVKIPEGTILTMDMLTVKVGEPKGYPPEDIFNLVGKKVLVTVEEDDTIMEELVDNHGKKIKS

SEQ ID NO: 855069 - protein, 606 aa, Homo sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 855070 - protein, 606 aa, Homo sapiens; identical to SEQ ID NO: 855069

SEQ ID NO: 855071 - protein, 489 aa, Homo sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFRYPPFIPWLLLSGS

SEQ ID NO: 855072 - protein, 598 aa, Homo sapiens
IGEYEAGLNRPRVVGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 855073 - protein, 606 aa, Homo sapiens; identical to SEQ ID NO: 855069

SEQ ID NO: 855074 - protein, 489 aa, Homo sapiens; identical to SEQ ID NO: 855071

SEQ ID NO: 855075 - protein, 275 aa, Homo sapiens [sequence omitted]

SEQ ID NO: 855076 - protein, 397 aa, Homo sapiens [sequence omitted]

SEQ ID NO: 855077 - protein, 397 aa, Homo sapiens [sequence omitted]

SEQ ID NO: 855078 - protein, 165 aa, Homo sapiens [sequence omitted]

SEQ ID NO: 855079 - protein, 146 aa, Homo sapiens
MTGKTQATVGGYLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 855080 - protein, 653 aa, Homo sapiens
RAADRREDPRLAEDGRGKPSLTGSPELGRASRWRRRNGEFLSSTALRMTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 855081 - protein, 606 aa, Homo sapiens; identical to SEQ ID NO: 855069

SEQ ID NO: 855082 - protein, 519 aa, Homo sapiens
MAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 855083 - protein, 462 aa, Homo sapiens
MEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 855084 - protein, 280 aa, Homo sapiens [sequence omitted]

SEQ ID NO: 855085 - protein, 140 aa, Homo sapiens
MTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 855086 - protein, 397 aa, Homo sapiens [sequence omitted]

SEQ ID NO: 855087 - protein, 377 aa, Homo sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIIKKKKKKKKKKKKKKKTRGNFWGGEKRVKKGHGTHTGLSSDRHFLCYTRGENLGGAPQIREAEYILQKAGVSLFYDCAHRRADHDRSDMMTRGRTTELKRRDSSSESRTYNVNTRERPEGRRRATEIESEPKYDDCIL

SEQ ID NO: 855088 - protein, 89 aa, Homo sapiens
TKFAGASTSFLSRARCGGSRRSPASKCRTTPASSWTCTCRGNASASNRIIGAKDHASIQMNVAEVDKVTGRFNGQFKTYAICGAIRRMG

SEQ ID NO: 855089 - protein, 89 aa, Homo sapiens
ARRIRQRIRHEILEEQAHHRRSPASKCRTTPASSWTCTCRGNASASNRIIGAKDHASIQMNVAEVDKVTGRFNGQFKTYAICGAIRRMG

SEQ ID NO: 855090 - protein, 88 aa, Homo sapiens
CRVTYAASVLSRARCGGSRRSPASKCRTTPASSWTCTCRGNASASNRIIGAKDHASIQMNVAEVDKVTGRFNGQFKTYAICGAIRRMG

SEQ ID NO: 855091 - protein, 79 aa, Homo sapiens
RSGAGFGGSRRSPASKCRTTPASSWTCTCRGNASASNRIIGAKDHASIQMNVAEVDKVTGRFNGQFKTYAICGAIRRMG

SEQ ID NO: 855092 - protein, 192 aa, Homo sapiens
EECRPLLLRPGPRASVMGAPQEGSDAGRGRFLGSEVRHSGPGAAFTPGGVSISSWNLQPPPFPVFHSPVLAAPHCPPEGVVSSPPESGLGPRPSSSARKSPETQVLDQALREGTLRLEWARPWLCPSDLNECVSLEPKESGRRGGTRLGGQSQQLPCPPAPPDLWQQAQPSLEMQNDAGEFVDLYVPRKCVR

SEQ ID NO: 855093 - protein, 80 aa, Homo sapiens
NSLVMRCGGSRRSPASKCRTTPASSWTCTCRGNASASNRIIGAKDHASIQMNVAEVDKVTGRFNGQFKTYAICGAIRRMG

SEQ ID NO: 855094 - protein, 89 aa, Homo sapiens; identical to SEQ ID NO: 855088

SEQ ID NO: 855095 - protein, 143 aa, Homo sapiens
MQDHFSRASAFIDELFQDRFFTREPQDTLPLPAFSLPTEDLTFFFPKSRIVPQLMPFFSVRAPEFHAMVQAFLGMIPGGLAGLGISTFIAGLQAPANGFYEKGAIPVCAGDLANPGCWYKHLDRRDSFVVSHTFRYGGGPPRG

SEQ ID NO: 855096 - protein, 111 aa, Homo sapiens
MLTQSNNRKTTAKPDDAYNNHTKIKKEAAYTTKFAAASTADRRSPASKCRTTPASSWTCTCRGNASASNRIIGAKDHASIQMNVAEVDKVTGRFNGQFKTYAICGAIRRMG

SEQ ID NO: 855097 - protein, 147 aa, Homo sapiens
MGAQVRRFEKSEPGTRAGVQAWDGDPIPQMATRGSRMGQRQKAQENAEKGPGRPSTPVAGRAKRESTRGPAPENLAGPRTPWANSRFQRVQKPLPRENRGRVDPVKSPHAQVSAPRLARVGQGSLSEARGETRREKQAREPHPRKGP

SEQ ID NO: 855098 - protein, 88 aa, Homo sapiens; identical to SEQ ID NO: 855090

SEQ ID NO: 855099 - protein, 84 aa, Homo sapiens
RPQQWLGRGWCVGSRRSPASKCRTTPASSWTCTCRGNASASNRIIGAKDHASIQMNVAEVDKVTGRFNGQFKTYAICGAIRRMG

SEQ ID NO: 855100 - protein, 115 aa, Homo sapiens
MPPRSSGPGNLKQPLARGMKAIQGQGRQKQFVGPLQLPDTKPDCGSSREGPRLSSPDPSPGQHVLVTSLPCTPGQGGAKDHASIQMNVAEVDKVTGRFNGQFKTYAICGAIRRMG

SEQ ID NO: 855101 - protein, 67 aa, Homo sapiens
RGCHPTVTRRLLELAKVPQSAPKAPKAKWILIPDTCHPTLNPWWTEAVSELFVSIGPFKSQLVKDLA

SEQ ID NO: 855102 - protein, 160 aa, Homo sapiens
MSSAFDHRRERISVDIYDTKGTHLLYIGITPEEAKYKLSKSEKDLVGTKGIPHLVTHDEPGAYRITRSGVIKGGVIPLQMDKGDMGRSLIYINVRHLDNRVYSVTGGEKHIGKPRREKEPPQKGTQERRTQRTMVRMKKTKLAKGDHTQKVGGGKNNAKQ

SEQ ID NO: 855103 - protein, 83 aa, Homo sapiens
RRGLRAQGWGWGGSGGLDAGDGVRGAGCGWGRDPRGRFAPGAGARFRPYSRRRAVTPQAQPSLEMQNDAGEFVDLYVPRKCVR

SEQ ID NO: 855104 - protein, 53 aa, Homo sapiens
MSPVSDPRGTLPGGQATCSWERFKVYYNGATGGKYVPRAGSWIWSRHMDSRAR

SEQ ID NO: 855105 - protein, 71 aa, Homo sapiens
GLAASFLSRARCGGSRRSPASKCRTTPASSWTCTCRGNASASNRIIGAKDHASIQMNVAEGELGAREAGRL

SEQ ID NO: 855106 - protein, 71 aa, Homo sapiens; identical to SEQ ID NO: 855105

SEQ ID NO: 855107 - protein, 111 aa, Homo sapiens; identical to SEQ ID NO: 855096

SEQ ID NO: 855108 - protein, 233 aa, Homo sapiens
QLSNDPLLKCFPLCLTGWAFHSTTVDVIDDVMRMAAINITAHCLGSPQDLFNGSREFSGSGSVPHLSSNVDNLIKSDIPTVFNVFLFLSVSWWFLEGFDDQGRGRRHHLNLGLSVLNGQFHCNPQALPVTRCLGNVITNFFWRQTQGADLGGQGRSGTDFTSGAPQVYDFDLVGVELRRHGGGGWCRMNRIRDDRRKLHLGLLRAGQQAQPSLEMQNDAGEFVDLYVPRKCVR

SEQ ID NO: 855109 - protein, 83 aa, Homo sapiens
RRLLLLNKRPLASRRSPASKCRTTPASSWTCTCRGNASASNRIIGAKDHASIQMNVAEVDKVTGRFNGQFKTYAICGAIRRMG

SEQ ID NO: 855110 - protein, 78 aa, Homo sapiens
HPLPNSARRRSPASKCRTTPASSWTCTCRGNASASNRIIGAKDHASIQMNVAEVDKVTGRFNGQFKTYAICGAIRRMG

SEQ ID NO: 855111 - protein, 94 aa, Homo sapiens
SMVSTQSAHYGRASFLSRARCGGSRRSPASKCRTTPASSWTCTCRGNASASNRIIGAKDHASIQMNVAEVDKVTGRFNGQFKTYAICGAIRRMG

SEQ ID NO: 855112 - protein, 83 aa, Homo sapiens; identical to SEQ ID NO: 855103

SEQ ID NO: 855113 - protein, 84 aa, Homo sapiens; identical to SEQ ID NO: 855099

SEQ ID NO: 855114 - protein, 192 aa, Homo sapiens; identical to SEQ ID NO: 855092

SEQ ID NO: 855115 - protein, 233 aa, Homo sapiens; identical to SEQ ID NO: 855108

SEQ ID NO: 855116 - protein, 79 aa, Homo sapiens; identical to SEQ ID NO: 855091

SEQ ID NO: 855117 - protein, 89 aa, Homo sapiens; identical to SEQ ID NO: 855088

SEQ ID NO: 855118 - protein, 115 aa, Homo sapiens
ARRIRQRIRHEILEEQAHHRRSPASKCRTTPASSWTCTCRGNASASNRIIGAKDHASIQMNVAEVDKVTGRFNGQFKTYAICGAIRRMGECFPGLCSSLRDIVDFTVRIGVCDGA

SEQ ID NO: 855119 - protein, 82 aa, Homo sapiens
GLAASFLSRARCGGSRRSPASKCRTTPASSWTCTCRGNASASNRIIGAKDHASIQMNVAEGESDDSILRLCAKADGIVSKNF

SEQ ID NO: 855120 - protein, 53 aa, Homo sapiens; identical to SEQ ID NO: 855104

SEQ ID NO: 855121 - protein, 88 aa, Homo sapiens; identical to SEQ ID NO: 855090

SEQ ID NO: 855122 - protein, 55 aa, Homo sapiens
MLSAGPFVGWGESDDSILRLCAKADGIVSKNFDWIATDLDSRPNLDSRPNLDSRA

SEQ ID NO: 855123 - protein, 111 aa, Homo sapiens
GLAASFLSRARCGGSRRSPASKCRTTPASSWTCTCRGNASASNRIIGAKDHASIQMNVAEVDKVTGRFNGQFKTYAICGAIRRMGECFPGLCSSLRDIVDFTVRIGVCDGA

SEQ ID NO: 855124 - protein, 711 aa, Homo sapiens
MSRRCLVRISGSGGVSRWRDSDTTALLTGRLRGRWPGLASATMAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQAYEERQRHWQREREALREDCAAQAQRAQRAQQLLQLQVFQLQQEKRQLQDDFAQLLQEREQLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEAKVQRAAAGVGGSLRAQVERLRVELQRERRRGEEQRDSFEGERLAWQAEKEQVIRYQKQLQHNYIQMYRRNRQLEQELQQLSLELEARELADLGLAEQAPCICLEEITATEI

SEQ ID NO: 855125 - protein, 669 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQAYEERQRHWQREREALREDCAAQAQRAQRAQQLLQLQVFQLQQEKRQLQDDFAQLLQEREQLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEAKVQRAAAGVGGSLRAQVERLRVELQRERRRGEEQRDSFEGERLAWQAEKEQVIRYQKQLQHNYIQMYRRNRQLEQELQQLSLELEARELADLGLAEQAPCICLEEITATEI

SEQ ID NO: 855126 - protein, 669 aa, Homo sapiens; identical to SEQ ID NO: 855125

SEQ ID NO: 855127 - protein, 669 aa, Homo sapiens; identical to SEQ ID NO: 855125

SEQ ID NO: 855128 - protein, 669 aa, Homo sapiens; identical to SEQ ID NO: 855125

SEQ ID NO: 855129 - protein, 315 aa, Homo sapiens
MQAYEERQRHWQREREALREDCAAQAQRAQRAQQLLQLQVFQLQQEKRQLQDDFAQLLQEREQLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEAKVQRAAAGVGGSLRAQVERLRVELQRERRRGEEQRDSFEGERLAWQAEKEQVIRYQKQLQHNYIQMYRRNRQLEQELQQLSLELEARELADLGLAEQAPCICLEEITATEI

SEQ ID NO: 855130 - protein, 463 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQAYEERQRHWQREREALREDCAAQAQRAQRAQQLLQLQVFQLQQEKRQLQDDFAQLLQEREQLERRCATLEREQRELGPRLEETKWEVCQKSGEISLLKQQLKESQAE

SEQ ID NO: 855131 - protein, 388 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEAKVQRAAAGVGGSLRAQVERLRVELQRERRRGEEQRDSFEGERLAWQAEKEQVIRYQKQLQHNYIQMYRRNRQLEQELQQLSLELEARELADLGLAEQAPCICLEEITATEI

SEQ ID NO: 855132 - protein, 285 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSLQRERRRGEEQRDSFEGERLAWQAEKEQVIRYQKQLQHNYIQMYRRNRQLEQELQQLSLELEARELADLGLAEQAPCICLEEITATEI

SEQ ID NO: 855133 - protein, 344 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDTTANPVHRRFQPTPARGAGKKKGLPPLHIPPDPKARESQMAPAAPDVPAHIGGQGRAWARFPGLSSAASLLE

SEQ ID NO: 855134 - protein, 641 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQAYEERQRHWQREREALREDCAAQAQRAQRAQQLLQLQVFQLQQEKRQLQDDFAQLLQEREQLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEAKVQRAAAGVGGSLRAQVERLRVELQRERRRGEEQRDSFEGERLAWQAEKEQVIRYQKQLQHNYIQMYRRNRQLEQEPGLGSQV

SEQ ID NO: 855135 - protein, 360 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEAKVQRAAAGVGGSLRAQVERLRVELQRERRRGEEQRDSFEGERLAWQAEKEQVIRYQKQLQHNYIQMYRRNRQLEQEPGLGSQV

SEQ ID NO: 855136 - protein, 138 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKRR

SEQ ID NO: 855137 - protein, 669 aa, Homo sapiens; identical to SEQ ID NO: 855125

SEQ ID NO: 855138 - protein, 669 aa, Homo sapiens; identical to SEQ ID NO: 855125

SEQ ID NO: 855139 - protein, 647 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQAYEERQRHWQREREALREDCAAQAQRAQRAQQLLQLQVFQLQQEKRQLQDDFAQLLQEREQLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEAKVQRAAAGVGGSLRAQVERLRVELQRERRRGEEQRDSFEGERLAWQAEKEQVIRYQKQLQHNYIQMYRRNRQLEQEPGPLHLPGGDHCY

SEQ ID NO: 855140 - protein, 625 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQAYEERQRHWQREREALREDCAAQAQRAQRAQQLLQLQVFQLQQEKRQLQDDFAQLLQEREQLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEAKVQRAAAGVGGSLRAQVERLRVELQRERRRGEEQRDSFEGERLAWQAEKEQVQAPCICLEEITATEI

SEQ ID NO: 855141 - protein, 419 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQPLPTLFTGASSPLQPGEQGRRRGSLLFTFPPTPKPEKARWHQLLRMCLPTLGDRAGPGLGSQV

SEQ ID NO: 855142 - protein, 387 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQAYEERQRHWQREREALPTLGDRAGPGLGSQV

SEQ ID NO: 855143 - protein, 91 aa, Homo sapiens
MPKQVVWHGHWPAALSKQVAQIPPTWTFSSGAAPATLSHWVCDSPLHLSILHHFPSRKTDGRKPSVTLLLRRSISGTDIICLVSVNSKESS

SEQ ID NO: 855144 - protein, 70 aa, Homo sapiens
EWKLYQKEDTLKCFTPGVTAPRVAAVSGSGMLLPQTSSRRATYTEPTREQPISEMGPHNFREALSTSCPS

SEQ ID NO: 855145 - protein, 121 aa, Homo sapiens
MFTPSESPIQSLASWRALRFWYKRHFISTKWKSIIHIHLLLRHFSLESSSCLSTLGKRTGLIYITDILVMVWRDLWERRPSRGLSEGSFRMQLFWAEDGLHWPPPRRKASRVEKCPLTWLL

SEQ ID NO: 855146 - protein, 507 aa, Homo sapiens
MCDIEEATNQLLDVNLHENQKSVQVTESDLGSESELLVTIGATVPTGFEQTAADEVREKLGSSCKISRDRGKIYFVISVESLAQVHCLRSVDNLFVVVQEFQDYQFKQTKEEVLKDFEDLAGKLPWSNPLKVWKINASFKKKKAKRKKINQNSSKEKINNGQEVKIDQRNVKKEFTSHALDSHILDYYENPAIKEDVSTLIGDDLASCKDETDESSKEETEPQVLKFRVTCNRAGEKHCFTSNEAARDFGGAVQDYFKWKADMTNFDVEVLLNIHDNEVIVGIALTEESLHRRNITHFGPTTLRSTLAYGMLRLCDPLPYDIIVDPMCGTGAIPIEGATEWSDCFHIAGDNNPLAVNRAANNIASLLTKSQIKEGKPSWGLPIDAVQWDICNLPLRTGSVDIIVTDLPFGKRMGSKKRNWNLYPACLREMSRVCTPTTGRAVLLTQDTKCFTKALSGMRHVWRKVDTVWVNVGGLRAAVYVLIRTPQAFVHPSEQDGERGTLWQCKE

SEQ ID NO: 855147 - protein, 507 aa, Homo sapiens; identical to SEQ ID NO: 855146

SEQ ID NO: 855148 - protein, 507 aa, Homo sapiens; identical to SEQ ID NO: 855146

SEQ ID NO: 855149 - protein, 507 aa, Homo sapiens; identical to SEQ ID NO: 855146

SEQ ID NO: 855150 - protein, 445 aa, Homo sapiens
MCDIEEATNQLLDVNLHENQKSVQVTESDLGSESELLVTIGATVPTGFEQTAADEVREKLGSSCKISRDRGKIYFVISVESLAQVHCLRSVDNLFVVVQEFQDYQFKQTKEEVLKDFEDLAGKLPWSNPLKVWKINASFKKKKAKRKKINQNSSKEKINNGQEVKIDQRNVKKEFTSHALDSHILDYYENPAIKEDVSTLIGDDLASCKDETDESSKEETEPQVLKFRVTCNRAGEKHCFTSNEAARDFGGAVQDYFKWKADMTNFDVEVLLNIHDNEVIVGIALTEESLHRRNITHFGPTTLRSTLAYGMLSKPSWGLPIDAVQWDICNLPLRTGSVDIIVTDLPFGKRMGSKKRNWNLYPACLREMSRVCTPTTGRAVLLTQDTKCFTKALSGMRHVWRKVDTVWVNVGGLRAAVYVLIRTPQAFVHPSEQDGERGTLWQCKE

SEQ ID NO: 855151 - protein, 485 aa, Homo sapiens
LYRIPSNRRFLSELLVTIGATVPTGFEQTAADEVREKLGSSCKISRDRGKIYFVISVESLAQVHCLRSVDNLFVVVQEFQDYQFKQTKEEVLKDFEDLAGKLPWSNPLKVWKINASFKKKKAKRKKINQNSSKEKINNGQEVKIDQRNVKKEFTSHALDSHILDYYENPAIKEDVSTLIGDDLASCKDETDESSKEETEPQVLKFRVTCNRAGEKHCFTSNEAARDFGGAVQDYFKWKADMTNFDVEVLLNIHDNEVIVGIALTEESLHRRNITHFGPTTLRSTLAYGMLRLCDPLPYDIIVDPMCGTGAIPIEGATEWSDCFHIAGDNNPLAVNRAANNIASLLTKSQIKEGKPSWGLPIDAVQWDICNLPLRTGSVDIIVTDLPFGKRMGSKKRNWNLYPACLREMSRVCTPTTGRAVLLTQDTKCFTKALSGMRHVWRKVDTVWVNVGGLRAAVYVLIRTPQAFVHPSEQDGERGTLWQCKE

SEQ ID NO: 855152 - protein, 484 aa, Homo sapiens
MCDIEEATNQLLDVNLHENQKSVQVTESDLGSESELLVTIGATVPTGFEQTAADEVREKLGSSCKISRDRGKIYFVISVESLAQVHCLRSVDNLFVVVQEFQDYQFKQTKEEVLKDFEDLAGKLPWSNPLKVWKINASFKKKKAKRKKINQNSSKEKINNGQEVKIDQRNVKKEFTSHALDSHILDYYENPAIKEDVSTLIGDDLASCKDETDESSKEETEPQVLKFRVTCNRAGEKHCFTSNEAARDFGGAVQDYFKWKADMTNFDVEVLLNIHDNEVIVGIALTEESLHRRNITHFGPTTLRSTLAYGMLRLCDPLPYDIIVDPMCGTGAIPIEGATEWSDCFHIAGDNNPLAVNRAANNIASLLTKSQIKEGKPSWGLPIDAVQWDICNLPLRTGSVDIIVTDLPFGKRPTTGRAVLLTQDTKCFTKALSGMRHVWRKVDTVWVNVGGLRAAVYVLIRTPQAFVHPSEQDGERGTLWQCKE

SEQ ID NO: 855153 - protein, 375 aa, Homo sapiens [sequence omitted]

SEQ ID NO: 855154 - protein, 507 aa, Homo sapiens; identical to SEQ ID NO: 855146

SEQ ID NO: 855155 - protein, 507 aa, Homo sapiens; identical to SEQ ID NO: 855146

SEQ ID NO: 855156 - protein, 507 aa, Homo sapiens; identical to SEQ ID NO: 855146

SEQ ID NO: 855157 - protein, 483 aa, Homo sapiens
MCDIEEATNQLLDVNLHENQKSVQVTESDLGSESELLVTIGATVPTGFEQTAADEVREKLGSSCKISRDRGKIYFVISVESLAQVHCLRSVDNLFVVVQEFQDYQFKQTKEEVLKDFEDLAGKLPWSNPLKVWKINASFKKKKAKRKKINQNSSKEKINNGQEVKIDQRNVKKEFTSHALDSHILDYYENPAIKEDVSTLIGDDLASCKDETDESSKEETEPQVLKFRVTCNRAGEKHCFTSNEAARDFGGAVQDYFKWKADMTNFDVEVLLNIHDNEVIVGIALTEESLHRRNITHFGPTTLRSTLAYGMLRLCDPLPYDIIVDPMCGTGAIPIEQTLLGLAHRCCSVGYLQSAIENWLCGYYCNRFAIWKKDGIQEKKLEPLSSLPTGDEPCLHTYHRPSCTTYSRHKMLYQGVIWNATRMAKGGYSLGERWWSSCCSLRSDTYTSSFCSSFRTRRRKRNSLAMQRMKMTNSTCTSHHWKC

SEQ ID NO: 855158 - protein, 434 aa, Homo sapiens
MKSERNLGHHAVHCLRSVDNLFVVVQEFQDYQFKQTKEEVLKDFEDLAGKLPWSNPLKVWKINASFKKKKAKRKKINQNSSKEKINNGQEVKIDQRNVKKEFTSHALDSHILDYYENPAIKEDVSTLIGDDLASCKDETDESSKEETEPQVLKFRVTCNRAGEKHCFTSNEAARDFGGAVQDYFKWKADMTNFDVEVLLNIHDNEVIVGIALTEESLHRRNITHFGPTTLRSTLAYGMLRLCDPLPYDIIVDPMCGTGAIPIEGATEWSDCFHIAGDNNPLAVNRAANNIASLLTKSQIKEGKPSWGLPIDAVQWDICNLPLRTGSVDIIVTDLPFGKRMGSKKRNWNLYPACLREMSRVCTPTTGRAVLLTQDTKCFTKALSGMRHVWRKVDTVWVNVGGLRAAVYVLIRTPQAFVHPSEQDGERGTLWQCKE

SEQ ID NO: 855159 - protein, 263 aa, Homo sapiens
MRGRDRGCSTRECKWKADMSNMSVEVLLNIHDNEVIVGIALTEESLHRRNITHFGPTTLRSTLAYGMLRLCDPLPYDIIVDPMCGTGAIPIEGATEWSDCFHIAGDNNPLAVNRAANNIASLLTKSQIKEGKPSWGLPIDAVQWDICNLPLRTGSVDIIVTDLPFGKRMGSKKRNWNLYPACLREMSRVCTPTTGRAVLLTQDTKCFTKALSGMRHVWRKVDTVWVNVGGLRAAVYVLIRTPQAFVHPSEQDGERGTLWQCKE

SEQ ID NO: 855160 - protein, 522 aa, Homo sapiens
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 855161 - protein, 522 aa, Homo sapiens; identical to SEQ ID NO: 855160

SEQ ID NO: 855162 - protein, 522 aa, Homo sapiens; identical to SEQ ID NO: 855160

SEQ ID NO: 855163 - protein, 522 aa, Homo sapiens; identical to SEQ ID NO: 855160

SEQ ID NO: 855164 - protein, 522 aa, Homo sapiens; identical to SEQ ID NO: 855160

SEQ ID NO: 855165 - protein, 522 aa, Homo sapiens; identical to SEQ ID NO: 855160

SEQ ID NO: 855166 - protein, 394 aa, Homo sapiens
MVARAGCCTTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 855167 - protein, 406 aa, Homo sapiens
MSVFSLLQKPTLSHPHQDIPAGVQPSSPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 855168 - protein, 87 aa, Homo sapiens
KVEAPSESAESGYSLHGCSKERRRRPRLKKEGGSGERRRAEVDVRLFSVAETHLVPSTSGHPSWSSTFIPSVAVRRLNQGPEKVEES

SEQ ID NO: 855169 - protein, 196 aa, Homo sapiens
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNMVMGISRQAAVPTSGKGDPLKRGR

SEQ ID NO: 855170 - protein, 522 aa, Homo sapiens; identical to SEQ ID NO: 855160

SEQ ID NO: 855171 - protein, 522 aa, Homo sapiens; identical to SEQ ID NO: 855160

SEQ ID NO: 855172 - protein, 522 aa, Homo sapiens; identical to SEQ ID NO: 855160

SEQ ID NO: 855173 - protein, 522 aa, Homo sapiens; identical to SEQ ID NO: 855160

SEQ ID NO: 855174 - protein, 522 aa, Homo sapiens; identical to SEQ ID NO: 855160

SEQ ID NO: 855175 - protein, 442 aa, Homo sapiens
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYVRGPRRHQ

SEQ ID NO: 855176 - protein, 522 aa, Homo sapiens; identical to SEQ ID NO: 855160

SEQ ID NO: 855177 - protein, 195 aa, Homo sapiens
MTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 855178 - protein, 220 aa, Homo sapiens
SSAPCSWQRPASGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 855179 - protein, 87 aa, Homo sapiens; identical to SEQ ID NO: 855168

SEQ ID NO: 855180 - protein, 1220 aa, Homo sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNASGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 855181 - protein, 1220 aa, Homo sapiens; identical to SEQ ID NO: 855180

SEQ ID NO: 855182 - protein, 175 aa, Homo sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQVKLYFTKTVEEPSNPEASSSTSVTPDVSDNEPDHYRYSDDH

SEQ ID NO: 855183 - protein, 74 aa, Homo sapiens
PGPAPRHATARRAPQGVRRLRGCSHTHWWKERPRSRLSTVSRVLQPTAEQLRVIFLLRGAPPSGFPRQHESRPL

SEQ ID NO: 855184 - protein, 74 aa, Homo sapiens; identical to SEQ ID NO: 855183

SEQ ID NO: 855185 - protein, 727 aa, Homo sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 855186 - protein, 74 aa, Homo sapiens; identical to SEQ ID NO: 855183

SEQ ID NO: 855187 - protein, 657 aa, Homo sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEEEEKKTKFENLCKIMKDILEKKVEKVVVSNRLVTSPCCIVTSTYGWTANMERIMKAQALRDNSTMGYMAAKRHLEINPDHSIIETLRLKAEADKNDKSVKDLVILLYV

SEQ ID NO: 855188 - protein, 74 aa, Homo sapiens; identical to SEQ ID NO: 855183

SEQ ID NO: 855189 - protein, 418 aa, Homo sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGA

SEQ ID NO: 855190 - protein, 1181 aa, Homo sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNASGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 855191 - protein, 877 aa, Homo sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNASGQLPTSPGHMHTQVPPYPQPQRK

SEQ ID NO: 855192 - protein, 1220 aa, Homo sapiens; identical to SEQ ID NO: 855180

SEQ ID NO: 855193 - protein, 74 aa, Homo sapiens; identical to SEQ ID NO: 855183

SEQ ID NO: 855194 - protein, 1207 aa, Homo sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKLLKTLTKSAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNASGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 855195 - protein, 74 aa, Homo sapiens; identical to SEQ ID NO: 855183

SEQ ID NO: 855196 - protein, 74 aa, Homo sapiens; identical to SEQ ID NO: 855183

SEQ ID NO: 855197 - protein, 1195 aa, Homo sapiens
PGSVGRRAWLRLRLPRWNGTWRWPWPGRRGGGECWESPTSAALTQDPAAEGPRQQDEVKGSRSYSHAGMEPCPESPHLPSNRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNASGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 855198 - protein, 288 aa, Homo sapiens
CDCFRGHVPRTGASSGWKPGARPEVPRTQPAQTLGEMTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 855199 - protein, 164 aa, Homo sapiens
MPCSEETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 855200 - protein, 164 aa, Homo sapiens; identical to SEQ ID NO: 855199

SEQ ID NO: 855201 - protein, 288 aa, Homo sapiens; identical to SEQ ID NO: 855198

SEQ ID NO: 855202 - protein, 164 aa, Homo sapiens; identical to SEQ ID NO: 855199

SEQ ID NO: 855203 - protein, 288 aa, Homo sapiens; identical to SEQ ID NO: 855198

SEQ ID NO: 855204 - protein, 182 aa, Homo sapiens
RLLPRSCSQDGRVFRVEAWRTSGETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 855205 - protein, 167 aa, Homo sapiens
MAAGGAAPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 855206 - protein, 288 aa, Homo sapiens; identical to SEQ ID NO: 855198

SEQ ID NO: 855207 - protein, 262 aa, Homo sapiens
CDCFRGHVPRTGASSGWKPGARPEVPRTQPAQTLGEMTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEGYGECVSNVSNKLFFL

SEQ ID NO: 855208 - protein, 279 aa, Homo sapiens
CDCFRGHVPRTGASSGWKPGARPEVPRTQPAQTLGEMTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQVSITKEDTE

SEQ ID NO: 855209 - protein, 249 aa, Homo sapiens
CDCFRGHVPRTGASSGWKPGARPEVPRTQPAQTLGEMTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEGLG

SEQ ID NO: 855210 - protein, 300 aa, Homo sapiens
CDCFRGHVPRTGASSGWKPGARPEVPRTQPAQTLGEMTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQPDRGATLSITPRRERYLNVRFHNSFLQSPV

SEQ ID NO: 855211 - protein, 229 aa, Homo sapiens
CDCFRGHVPRTGASSGWKPGARPEVPRTQPAQTLGEMTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGGLLFGVEY

SEQ ID NO: 855212 - protein, 288 aa, Homo sapiens; identical to SEQ ID NO: 855198

SEQ ID NO: 855213 - protein, 265 aa, Homo sapiens
CDCFRGHVPRTGASSGWKPGARPEVPRTQPAQTLGEMTPLCPRPALCYHFLTSLLRSAMQNARGARQRAEAAVLSGPGPPLGRAAQHGIPRPLSSAGRLSQGCRGAKTPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 855214 - protein, 121 aa, Homo sapiens
MLCSIEKPSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 855215 - protein, 262 aa, Homo sapiens; identical to SEQ ID NO: 855207

SEQ ID NO: 855216 - protein, 69 aa, Homo sapiens
MENGAVYSPTTEEDPGPARGPRSGLAAYFFMGRLPLLRRVLKGLQLLLSLLAFICVDVGSRCAFCPAAV

SEQ ID NO: 855217 - protein, 217 aa, Homo sapiens
RGERVSLGRALGVNFVPDCQRRGCCGRRAPRPEAMENGAVYSPTTEEDPGPARGPRSGLAAYFFMGRLPLLRRVLKGLQLLLSLLAFICEEVVSQCTLCGGLYFFEFVSCSAFLLSLLILIVYCTPFYERVDTTKVKSSDFYITLGTGCVFLLASIIFVSTHDRTSAEIAAIVFGFIASFMFLLDFITMLYEKRQESQLRKPENTTRAEALTEPLNA

SEQ ID NO: 855218 - protein, 183 aa, Homo sapiens
MENGAVYSPTTEEDPGPARGPRSGLAAYFFMGRLPLLRRVLKGLQLLLSLLAFICEEVVSQCTLCGGLYFFEFVSCSAFLLSLLILIVYCTPFYERVDTTKVKSSDFYITLGTGCVFLLASIIFVSTHDRTSAEIAAIVFGFIASFMFLLDFITMLYEKRQESQLRKPENTTRAEALTEPLNA

SEQ ID NO: 855219 - protein, 183 aa, Homo sapiens; identical to SEQ ID NO: 855218

SEQ ID NO: 855220 - protein, 144 aa, Homo sapiens
MENGAVYSPTTEEDPGPARGPRSGLAAYFFMGRLPLLRRVLKGLQLLLSLLAFICEEVVSQCTLCGGLYFFEFVSCSAFLLSLLILIVYCTPFYERVDTTKVKSSDFYITLGTGCVFLLASIIFVSTHDRTSAEIAAIVSTLYF

SEQ ID NO: 855221 - protein, 183 aa, Homo sapiens; identical to SEQ ID NO: 855218

SEQ ID NO: 855222 - protein, 169 aa, Homo sapiens
MENGAVYSPTTEEDPGPARGPRSGLAAYFFMGRLPLLRRVLKGLQLLLSLLAFICEEVVSQCTLCGGLYFFEFVSCSAFLLSLLILIVYCTPFYERVDTTKVKSSASIIFVSTHDRTSAEIAAIVFGFIASFMFLLDFITMLYEKRQESQLRKPENTTRAEALTEPLNA

SEQ ID NO: 855223 - protein, 183 aa, Homo sapiens; identical to SEQ ID NO: 855218

SEQ ID NO: 855224 - protein, 107 aa, Homo sapiens
MENGAVYSPTTEEDPGPARGPRSGLAAYFFMGRLPLLRRVLKGLQLLLSLLAFICEEVVSQCTLCGGLYFFEFVSCSAFLLSLLILIVYCTPFYERVDTTKVKSSNF

SEQ ID NO: 855225 - protein, 153 aa, Homo sapiens
MSWTFEYFVTKLDAVKILWKIFLVFWFHFSGQLTWLGSDCLCGLWIQFELTFQNLRIAVQVPGVPSMPLCSSQRLSSAALGQFTHGHVGGKLEIVYTNLEDVSSLRDFPCTQAPKSFFSWFFGEKTGILASLCFSYVFCRGAHFLNKMEREKS

SEQ ID NO: 855226 - protein, 153 aa, Homo sapiens; identical to SEQ ID NO: 855225

SEQ ID NO: 855227 - protein, 531 aa, Homo sapiens
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPRQGPLCRQDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTASKAESVCDGQAGQKTSEIQARGTKKKHLDSPRLGLAFRKFFRHKGAEKSPTTSADLKSDKANFTSQETQGAGKNSKGCNPSGHTQSVTTPEPAKEGTKEKSGPTSLPLGKLFWKKTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 855228 - protein, 639 aa, Homo sapiens
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPRHAPAQRQGPLCRQDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTFEVVTAVAPKASKAESVCDGQAGQKTSEIQARGTKKKHLDSPRLGLAFRKFFRHKGAEKSPTTSADLKSDKANFTSQETQGAGKNSKGCNPSGHTQSVTTPEPAKEGTKEKSGPTSLPLGKLFWKKSVKEDSVPTGAEENVVCESPVEIIKSKEVESALQTVDLNEGDAAPEPTEAKLKREESKPRTSLMAFLRQMSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 855229 - protein, 644 aa, Homo sapiens
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPRQGPLCRQDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTASKAESVCDGQAGQKTSEIQARGTKKKHLDSPRLGLAFRKFFRHKGAEKSPTTSADLKSDKANFTSQETQGAGKNSKGCNPSGHTQSVTTPEPAKEGTKEKSGPTSLPLGKLFWKKSVKEDSVPTGAEENVVCESPVEIIKSKEVESALQTVDLNEGDAAPEPTEAKLKREESKPRTSLMAFLRQMSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSKYTGKCVFSHVKKKWPFQEWSY

SEQ ID NO: 855230 - protein, 411 aa, Homo sapiens
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPRQGPLCRQDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTASKAESVCDGQAGQKTSEIQARGTKKKHLDSPRLGLAFRKFFRHKRVLKKFTQPLQLTFKVRNKSQLLPFPREDPKGAWHKEISQKGNWPTPIRGGTTTKFPGGTKPP

SEQ ID NO: 855231 - protein, 584 aa, Homo sapiens
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPRHAPAQRQGPLCRQDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENVVCESPVEIIKSKEVESALQTVDLNEGDAAPEPTEAKLKREESKPRTSLMAFLRQMSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 855232 - protein, 609 aa, Homo sapiens
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPRQGPLCRQDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTASKAESVCDGQAGQKTSEIQARGTKKKHLDSPRLGLAFRKFFRHKGAEKSPTTSADLKSDKANFTSQETQGAGKNSKGCNPSGHTQSVTTPEPAKEGTKEKSGPTSLPLGKLFWKKVVCESPVEIIKSKEVESALQTVDLNEGDAAPEPTEAKLKREESKPRTSLMAFLRQMSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 855233 - protein, 528 aa, Homo sapiens
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPRHAPAQRQGPLCRQDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 855234 - protein, 135 aa, Homo sapiens
MGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYSLSTRGPDREF

SEQ ID NO: 855235 - protein, 120 aa, Homo sapiens
LVLARIVEEGRPAGAGRPEEALAAGSDPRGAAARLACSAPTPGGGTMPFDFRRFDIYRKVPKDLTQPTYTGAIISICCCLFILFLFLSELTGFITTEVVNELYVDDPDKDSGGKIDSESV

SEQ ID NO: 855236 - protein, 198 aa, Homo sapiens
MGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 855237 - protein, 198 aa, Homo sapiens; identical to SEQ ID NO: 855236

SEQ ID NO: 855238 - protein, 198 aa, Homo sapiens; identical to SEQ ID NO: 855236

SEQ ID NO: 855239 - protein, 198 aa, Homo sapiens; identical to SEQ ID NO: 855236

SEQ ID NO: 855240 - protein, 198 aa, Homo sapiens; identical to SEQ ID NO: 855236

SEQ ID NO: 855241 - protein, 252 aa, Homo sapiens
MPFDFRRFDIYRKVPKDLTQPTYTGAIISICCCLFILFLFLSELTGFITTEVVNELYVDDPDKDSGGKIDLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 855242 - protein, 132 aa, Homo sapiens
MTSELSAGSARPPASFCCVLPAALASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 855243 - protein, 198 aa, Homo sapiens; identical to SEQ ID NO: 855236

SEQ ID NO: 855244 - protein, 198 aa, Homo sapiens; identical to SEQ ID NO: 855236

SEQ ID NO: 855245 - protein, 198 aa, Homo sapiens; identical to SEQ ID NO: 855236

SEQ ID NO: 855246 - protein, 198 aa, Homo sapiens; identical to SEQ ID NO: 855236

SEQ ID NO: 855247 - protein, 116 aa, Homo sapiens
GRAAPNGLRGASLPGSGRRVASGEWRVSGGRPAGAGRPEEALAAGSDPRGAAARLACSAPTPGGGTMPFDFRSRLPKGTPLYTRHLPRKMVLPKQAPMICHYRWNPDFCPIPSCPT

SEQ ID NO: 855248 - protein, 204 aa, Homo sapiens
MGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSGHCLDSEHCLDSGHCLDSGHCLDS

SEQ ID NO: 855249 - protein, 128 aa, Homo sapiens
MGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKNTSLST

SEQ ID NO: 855250 - protein, 140 aa, Homo sapiens
GRAAPNGLRGASLPGSGRRVASGEWRVSGGRPAGAGRPEEALAAGSDPRGAAARLACSAPTPGGGTMPFDFRRFDIYRKVPKDLTQPTYTGAIISICCCLFILFLFLSELTGFITTEVVNELYVDDPDKDSGGKIDSESV

SEQ ID NO: 855251 - protein, 140 aa, Homo sapiens; identical to SEQ ID NO: 855250

SEQ ID NO: 855252 - protein, 198 aa, Homo sapiens; identical to SEQ ID NO: 855236

SEQ ID NO: 855253 - protein, 112 aa, Homo sapiens [sequence omitted]

SEQ ID NO: 855254 - protein, 198 aa, Homo sapiens; identical to SEQ ID NO: 855236

SEQ ID NO: 855255 - protein, 198 aa, Homo sapiens; identical to SEQ ID NO: 855236

SEQ ID NO: 855256 - protein, 198 aa, Homo sapiens; identical to SEQ ID NO: 855236

SEQ ID NO: 855257 - protein, 271 aa, Homo sapiens
MGRHEVGHIDNSMKIPLNNGAGCRFEGQFSINKELTSSQMSEFACFEQQRQPHQRPHGDLVSSASPAGGGQDGTCLQNQTLMGCCTISYIPSSDTARTVFSLGWNKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 855258 - protein, 198 aa, Homo sapiens; identical to SEQ ID NO: 855236

SEQ ID NO: 855259 - protein, 220 aa, Homo sapiens
MALKMHTRKAVQTTGSNSGTTVPYKFHVPTVPRLVQATDHSPSDHPGSQAHKPNAVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 855260 - protein, 184 aa, Homo sapiens
SLNIRLPNCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 855261 - protein, 198 aa, Homo sapiens; identical to SEQ ID NO: 855236

SEQ ID NO: 855262 - protein, 198 aa, Homo sapiens; identical to SEQ ID NO: 855236

SEQ ID NO: 855263 - protein, 198 aa, Homo sapiens; identical to SEQ ID NO: 855236

SEQ ID NO: 855264 - protein, 135 aa, Homo sapiens
MGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKVRWPNTVRGPTSA

SEQ ID NO: 855265 - protein, 145 aa, Homo sapiens
MGRHEVGHIDNSMKIPLNNGAGCRFEGQFSINKVPGNFHVSTHSATAQPQNPDMTHVIHKLSFGDTLQVQNIHGAFNALGGADRLTSNPNQWEGGPSPVQTQTLTEKEEGLSRGTADARTQWIPAITIIVALITATSSSLVELIT

SEQ ID NO: 855266 - protein, 140 aa, Homo sapiens; identical to SEQ ID NO: 855250

SEQ ID NO: 855267 - protein, 187 aa, Homo sapiens
MTSREHQVSLCNCVPLLRRLLCDAPWRKARPLHALSRYFRSRVSPSKMAEEPQSVLQLPTSIAAGGEGLTDVSPETTTPEPPSSAAVSPGTEEPAGDTKKKIDILLKAVGDTPIMKTKKWAVERTRTIQGLIDFIKKFLKLVASEQLFIYVNQSFAPSPDQEVGTLYECFGSDGKLVLHYCKSQAWG

SEQ ID NO: 855268 - protein, 187 aa, Homo sapiens; identical to SEQ ID NO: 855267

SEQ ID NO: 855269 - protein, 187 aa, Homo sapiens; identical to SEQ ID NO: 855267

SEQ ID NO: 855270 - protein, 187 aa, Homo sapiens; identical to SEQ ID NO: 855267

SEQ ID NO: 855271 - protein, 187 aa, Homo sapiens; identical to SEQ ID NO: 855267

SEQ ID NO: 855272 - protein, 122 aa, Homo sapiens
MTSREHQVSLCNCVPLLRRLLCDAPWRKARPLHALSRYFRSRVSPSKMAEEPQSVLQLPTSIAAGGEGLTDVSPETTTPEPPSSAAVSPGTEEPAGDTKKKNDSGLWPGAVAHSCNPSTLVG

SEQ ID NO: 855273 - protein, 121 aa, Homo sapiens
MTSREHQVSLCNCVPLLRRLLCDAPWRKARPLHALSRYFRSRVSPSKMAEEPQSVLQLPTSIAAGGEGLTDVSPETTTPEPPSSAAVSPGTEEPAGDTKKKIYLCESVLCSFPRPRSWNSL

SEQ ID NO: 855274 - protein, 108 aa, Homo sapiens
MTSREHQVSLCNCVPLLRRLLCDAPWRKARPLHALSRYFRSRVSPSKMAEEPQSVLQLPTSIAAGGEGLTDVSPETTTPEPPSSAAVSPGTEEPAGDTKKKIGCEFTP

SEQ ID NO: 855275 - protein, 187 aa, Homo sapiens; identical to SEQ ID NO: 855267

SEQ ID NO: 855276 - protein, 108 aa, Homo sapiens; identical to SEQ ID NO: 855274

SEQ ID NO: 855277 - protein, 187 aa, Homo sapiens; identical to SEQ ID NO: 855267

SEQ ID NO: 855278 - protein, 149 aa, Homo sapiens
MTSREHQVSLCNCVPLLRRLLCDAPWRKARPLHALSRYFRSRVSPSKMAEEPQSVLQLPTSIAAGGEGLTDVSPETTTPEPPSSAAVSPGTEEPAGDTKKKIDILLKAVGDTPIMKTKKWAVERTRTIQGLIDFIILCSFPRPRSWNSL

SEQ ID NO: 855279 - protein, 187 aa, Homo sapiens; identical to SEQ ID NO: 855267

SEQ ID NO: 855280 - protein, 1061 aa, Homo sapiens
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIEEEIVELPDLDYLRTMTHIVFVDFDNWSNFFGHLPGHLNQGTFIWGFQGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKECDSDDNMGAKNTSIGEEFISTEDVELEEAIRRSLEEM

SEQ ID NO: 855281 - protein, 102 aa, Homo sapiens [sequence omitted]

SEQ ID NO: 855282 - protein, 559 aa, Homo sapiens
MGDPGSEIIESVPPAGPEASESTTDENEDDIQFVSEGPLRPVLEYIDLVSSDDEEPSTSYTDRMPESKVPSSENHRPEMCSSCNVPLPIGDSSSFSGSCSSSPERIVSQTSSVENPLENQKNDQNNSDTKISETETLKSSQNFQTLPSSPLLVPQESLASSEVKENLRIDSSSASQHGRDAILYLQTQVAEMSRVIRDLQSRSCFRFHHSRPSENSSVPWDISTSKEENLSTVEEETDYKSPSADDKGQPSDPSQSSFTGLLKRMEQRGVIKRVTLQSEAESCEGKPDCVTSKKRLVPPLHPLLRIATTEVFKDPADCHPSSFMGHRVYPVAKDTSPFQPNPPAEGPIVEALEHSKRGNTTSPLDSTSKEMEVMGCRFYHAASIAARAASYMAYMTQYQRKLWEDMEDLVHDPEFDRGKARCIISDGMDAGLWQLCTTRDIMDSVVRVMAMAIDYRRQAWLRLTSLTKKTQEKISHLPFDGTSLFGQDVKAVVAEDNNIKENDYKDHKYYNQHRYFYSHDQKAHYHNRGYSKGDWYKPRNHPYRYRKKGDSPERHGYKN

SEQ ID NO: 855283 - protein, 826 aa, Homo sapiens
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTNTKNNKKKKIVVGRARGPGEKSSFKETLLVWGRARRPSCGVLWNPVAPKAWVPKRGARWGPEHNVALGFSYPQRKKSRAGGHPQGGFREHNSLGRGFRAGPYSGGVITAGSQGGSDNITRARGGG

SEQ ID NO: 855284 - protein, 192 aa, Homo sapiens
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKR

SEQ ID NO: 855285 - protein, 1061 aa, Homo sapiens; identical to SEQ ID NO: 855280

SEQ ID NO: 855286 - protein, 481 aa, Homo sapiens
MCSSCNVPLPIGDSSSFSGSCSSSPERIVSQTSSVENPLENQKNDQNNSDTKISETETLKSSQNFQTLPSSPLLVPQESLASSEVKENLRIDSSSASQHGRDAILYLQTQVAEMSRVIRDLQSRSCFRFHHSRPSENSSVPWDISTSKEENLSTVEEETDYKSPSADDKGQPSDPSQSSFTGLLKRMEQRGVIKRVTLQSEAESCEGKPDCVTSKKRLVPPLHPLLRIATTEVFKDPADCHPSSFMGHRVYPVAKDTSPFQPNPPAEGPIVEALEHSKRGNTTSPLDSTSKEMEVMGCRFYHAASIAARAASYMAYMTQYQRKLWEDMEDLVHDPEFDRGKARCIISDGMDAGLWQLCTTRDIMDSVVRVMAMAIDYRRQAWLRLTSLTKKTQEKISHLPFDGTSLFGQDVKAVVAEDNNIKENDYKDHKYYNQHRYFYSHDQKAHYHNRGYSKGDWYKPRNHPYRYRKKGDSPERHGYKN

SEQ ID NO: 855287 - protein, 102 aa, Homo sapiens
MGDPGSEIIESVPPAGPEASESTTDENEDDIQFVSEGPLRPVLEYIDLVSSDDEEPSTSYTDVPYTTGFFCSRTTGPQKICFLLEKRICRDPFRNGKWGKGL

SEQ ID NO: 855288 - protein, 1127 aa, Homo sapiens
PGSERKRLRGHERASKGRSSFEEVLRLFPPVASALTQGRVPVAPGGAGREGDSWRRRRQGQQEQWCCQRGRRRHGRPGVGAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIEEEIVELPDLDYLRTMTHIVFVDFDNWSNFFGHLPGHLNQGTFIWGFQGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKECDSDDNMGAKNTSIGEEFISTEDVELEEAIRRSLEEM

SEQ ID NO: 855289 - protein, 798 aa, Homo sapiens
SRGSLKSALFYIYHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIEEEIVELPDLDYLRTMTHIVFVDFDNWSNFFGHLPGHLNQGTFIWGFQGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKECDSDDNMGAKNTSIGEEFISTEDVELEEAIRRSLEEM

SEQ ID NO: 855290 - protein, 1061 aa, Homo sapiens; identical to SEQ ID NO: 855280

SEQ ID NO: 855291 - protein, 932 aa, Homo sapiens
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIEEEIVELPDLDYLRTMTHIVFVDFDNWSNFFGHLPGHLNQGTFIWGFQGTVNKKNKRKLFPTS

SEQ ID NO: 855292 - protein, 1041 aa, Homo sapiens
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIEEEIVELPDLDYLRTMTHIVFVDFDNWSNFFGHLPGHLNQGTFIWGFQGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKGTQLQSQCKPPKRRRLHC

SEQ ID NO: 855293 - protein, 1094 aa, Homo sapiens
MAARQAVGSGAQETCGLDRILEALKLLLSPGGSGSSSLQVTKHDVLLATLKSNLSALEDKFLKDPQWKNLKLLRDEIADKAEWPQNSVDVTWSFTSQTLLLLLCLKETMIRLAANFNPGKPNPRTPEVAPALSPDALSISQQKTVQFVLQFVVTLGICPYLMPGVGVPLRYRTEFGAVVQDVVCFDAAPDATRRLYTSCKALLNVAQHTSLGSLIFCHHFGDIAAGLCQLGFCPTKRKLLTPAEEVLTEEERTLSRGALRDMLDQVYQPLAVRELLILQGGPPQSCTDVKTQMRCRAPAWLRRLCGQLLSERLMRPNGVQAVVRGILEGAGAGAAGGSDAEVTAADWKKCDLIAKILASCPQQSLSPENYYRDICPQVLDLFHFQDKLTARQFQRVATTTFITLSRERPHLAAKYLLQPVLAPLHRCLNTAELSESDMVPGTILVTEEELSRCIEDVFKVYVVGNEPLTVLMDSLLPVLGVLFLLYCFTKQSVSHIRSLCQEILLWILGKLERKKAIASLKGFAGLDKAVPSLHSLCQFRVATQGGIMITIKEAISDEDEDEALYQKVSSEQGRVEHLGDLLSHCQECGLAGDFFIFCLKELTHVASENETELKTEPFSSKSLLELEQHQTLLVEGQERKLLVLQLMAVLCERMSEQIFTNVTQVVDFVAATLQRACASLAHQAESTVESQTLSMSMGLVAVMLGGAVQLKSSDFAVLKQLLPLLEKVSNTYPDPVIQELAVDLRITISTHGAFATEAVSMAAQSTLNRKDLEGKIEEQQQTSHERPTDVAHSHLEQQQSHETAPQTGLQSNAPIIPQGVNEPSTTTSQKSGSVTTEQLQEVLLSAYDPQIPTRAAALRTLSHWIEQREAKALEMQEKLLKIFLENLEHEDTFVYLSAIQGVALLSDVYPEKILPDLLAQYDSSKDKHTPETRMKVGEVLMRIVRALGDMVSKYREPLIHTFLRGVRDPDGAHRASSLANLGELCQRLDFLLGSVVHEVTACLIAVAKTDGEVQVRRAAIHVVVLLLRGLSQKATEVLSAVLKDLYHLLKHVVCLEPDDVAKLHAQLALEELDDIMKNFLFPPQKLEKKIMVLP

SEQ ID NO: 855294 - protein, 204 aa, Homo sapiens
MNPFFLFSTPGVALLSDVYPEKILPDLLAQYDSSKDKHTPETRMKVGEVLMRIVRALGDMVSKYREPLIHTFLRGVRDPDGAHRASSLANLGELCQRLDFLLGSVVHEVTACLIAVAKTDGEVQVRRAAIHVVVLLLRGLSQKATEVLSAVLKDLYHLLKHVVCLEPDDVAKLHAQLALEELDDIMKNFLFPPQKLEKKIMVLP

SEQ ID NO: 855295 - protein, 1094 aa, Homo sapiens; identical to SEQ ID NO: 855293

SEQ ID NO: 855296 - protein, 688 aa, Homo sapiens
MAARQAVGSGAQETCGLDRILEALKLLLSPGGSGSSSLQVTKHDVLLATLKSNLSALEDKFLKDPQWKNLKLLRDEIADKAEWPQNSVDVTWSFTSQTLLLLLCLKETMIRLAANFNPGKPNPRTPEVAPALSPDALSISQQKTVQFVLQFVVTLGICPYLMPGVGVPLRYRTEFGAVVQDVVCFDAAPDATRRLYTSCKALLNVAQHTSLGSLIFCHHFGDIAAGLCQLGFCPTKRKLLTPAEEVLTEEERTLSRGALRDMLDQVYQPLAVRELLILQGGPPQETLSMSMGLVAVMLGGAVQLKSSDFAVLKQLLPLLEKVSNTYPDPVIQELAVDLRITISTHGAFATEAVSMAAQSTLNRKDLEGKIEEQQQTSHERPTDVAHSHLEQQQSHETAPQTGLQSNAPIIPQGVNEPSTTTSQKSGSVTTEQLQEVLLSAYDPQIPTRAAALRTLSHWIEQREAKALEMQEKLLKIFLENLEHEDTFVYLSAIQGVALLSDVYPEKILPDLLAQYDSSKDKHTPETRMKVGEVLMRIVRALGDMVSKYREPLIHTFLRGVRDPDGAHRASSLANLGELCQRLDFLLGSVVHEVTACLIAVAKTDGEVQVRRAAIHVVVLLLRGLSQKATEVLSAVLKDLYHLLKHVVCLEPDDVAKLHAQLALEELDDIMKNFLFPPQKLEKKIMVLP

SEQ ID NO: 855297 - protein, 316 aa, Homo sapiens
MAARQAVGSGAQETCGLDRILEALKLLLSPGGSGSSSLQVTKHDVLLATLKSNLSALEDKFLKDPQWKNLKLLRDEIADKAEWPQNSVDVTWSFTSQTLLLLLCLKETMIRLAANFNPGKPNPRTPEVAPALSPDALSISQQKTVQFVLQFVVTLGICPYLMPGVGVPLRYRTEFGAVVQDVVCFDAAPDATRRLYTSCKALLNVAQHTSLGSLIFCHHFGDIAAGLCQLGFCPTKRKLLTPAEEVLTEEERTLSRGALRDMLDQVYQPLAVRELLILQGGPPQDSGLGTLGGDSLMIMCGLLSSSGKLNNFSSLF

SEQ ID NO: 855298 - protein, 169 aa, Homo sapiens
MWEGFSAVTVKGRASPRLLLVIVGPVSVPGRPAVLTSLLNEELDRIPGRGPGVSESRSAGACALCPAVLKSRGTCPLLAGRFLRNWKCHEMWPSLGWRSLASLVPVQEELINSVVISQLSHIPEDKDHQVRKLATQLLVDLAEGCHTHHFNSLLDIIEKVRAVVPGAGC

SEQ ID NO: 855299 - protein, 108 aa, Homo sapiens
MTPDVWPGWLLEWMVLSASGIRVGLPAEPAGHPHPLRGRARPGSDATLPLLLSPQSNSELAILSNEHGSYRYTEFLTGLGRLIELKDCHLRGSRLLQPQPTSGAPSVP

SEQ ID NO: 855300 - protein, 98 aa, Homo sapiens
PSLCSFFVFLQLYHSPFFGDESNKPILLPNESQSFERSVQLLDQIPSYDTHKIAVLYVGEGQSNSELAILSNEHGSYRYTEFLTGLGRLIELKDCRVW

SEQ ID NO: 855301 - protein, 1974 aa, Homo sapiens
RFLAWGERGQRSGAPETQPLRTAIFGKKAQGGNAGPHVGTVRGCRVCSPCPRSWEPQEAARDSSLQPLSRLLPRSSHGAALPAAASLLRRGPGSSLHPRGPAPGPRLRLRVSILALKAVMPDSCGLHIPAAHAAPSRDARIAGLSARGRHRTTTPSKLPRRPSAQCRYRKCGSRFRRRPGARGVRLSPRRGGPERGGAAREGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTVASFSSLYQSSCQGQLHRSVSWADSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855302 - protein, 2017 aa, Homo sapiens
RFLAWGERGQRSGAPETQPLRTAIFGKKAQGGNAGPHVGTVRGCRVCSPCPRSWEPQEAARDSSLQPLSRLLPRSSHGAALPAAASLLRRGPGSSLHPRGPAPGPRLRLRVSILALKAVMPDSCGLHIPAAHAAPSRDARIAGLSARGRHRTTTPSKLPRRPSAQCRYRKCGSRFRRRPGARGVRLSPRRGGPERGGAAREGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSLRIARPPKQGLNNSPPVKEFKESSAAEAFRCRSISVSEHVVRSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTVASFSSLYQSSCQGQLHRSVSWADSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855303 - protein, 1951 aa, Homo sapiens
RFLAWGERGQRSGAPETQPLRTAIFGKKAQGGNAGPHVGTVRGCRVCSPCPRSWEPQEAARDSSLQPLSRLLPRSSHGAALPAAASLLRRGPGSSLHPRGPAPGPRLRLRVSILALKAVMPDSCGLHIPAAHAAPSRDARIAGLSARGRHRTTTPSKLPRRPSAQCRYRKCGSRFRRRPGARGVRLSPRRGGPERGGAAREGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855304 - protein, 1558 aa, Homo sapiens
LGHPGSAAGTELGAPCRMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855305 - protein, 1462 aa, Homo sapiens
EQQLPSQPLWPLERIWGVSWATWVRVAPGEDLGVSQPMRPGAASEGWGRLSPCGPERPERAEGVSMRWVCSEASGAKSMWGVEVSLCHRAWYLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855306 - protein, 1277 aa, Homo sapiens
MWPSLGWRSLASLVPVQEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855307 - protein, 1085 aa, Homo sapiens
MWMSPICAFPKWGSRAVHLTFLVCYLAGTPTTPKGRPFLGGRQEGSPAPLPPFLGLRSQGLPSPSGYPVTWPLGRGFMPGFGHQLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855308 - protein, 798 aa, Homo sapiens
PKGFKPPPPRVGSEAGWPENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855309 - protein, 1105 aa, Homo sapiens
RFLAWGERGQRSGAPETQPLRTAIFGKKAQGGNAGPHVGTVRGCRVCSPCPRSWEPQEAARDSSLQPLSRLLPRSSHGAALPAAASLLRRGPGSSLHPRGPAPGPRLRLRVSILALKAVMPDSCGLHIPAAHAAPSRDARIAGLSARGRHRTTTPSKLPRRPSAQCRYRKCGSRFRRRPGARGVRLSPRRGGPERGGAAREGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAM

SEQ ID NO: 855310 - protein, 403 aa, Homo sapiens
MSVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855311 - protein, 193 aa, Homo sapiens [sequence omitted]

SEQ ID NO: 855312 - protein, 308 aa, Homo sapiens
MTPDVWPGWLLEWMVLSASGIRVGLPAEPAGHPHPLRGRARPGSDATLPLLLSPQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855313 - protein, 1104 aa, Homo sapiens
RFLAWGERGQRSGAPETQPLRTAIFGKKAQGGNAGPHVGTVRGCRVCSPCPRSWEPQEAARDSSLQPLSRLLPRSSHGAALPAAASLLRRGPGSSLHPRGPAPGPRLRLRVSILALKAVMPDSCGLHIPAAHAAPSRDARIAGLSARGRHRTTTPSKLPRRPSAQCRYRKCGSRFRRRPGARGVRLSPRRGGPERGGAAREGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIA

SEQ ID NO: 855314 - protein, 440 aa, Homo sapiens
RFLAWGERGQRSGAPETQPLRTAIFGKKAQGGNAGPHVGTVRGCRVCSPCPRSWEPQEAARDSSLQPLSRLLPRSSHGAALPAAASLLRRGPGSSLHPRGPAPGPRLRLRVSILALKAVMPDSCGLHIPAAHAAPSRDARIAGLSARGRHRTTTPSKLPRRPSAQCRYRKCGSRFRRRPGARGVRLSPRRGGPERGGAAREGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQVRPRATLGWVTSGCPLTVLSLLGRVWTPASGERLGVLRALFFKVIKDYPSNEDLHERLEVFKALTDNGRHITYLEEELADFVLQWMDVGLSSEFLLVLVNLVKFNSCYLDEYIARMVQ

SEQ ID NO: 855315 - protein, 449 aa, Homo sapiens
RFLAWGERGQRSGAPETQPLRTAIFGKKAQGGNAGPHVGTVRGCRVCSPCPRSWEPQEAARDSSLQPLSRLLPRSSHGAALPAAASLLRRGPGSSLHPRGPAPGPRLRLRVSILALKAVMPDSCGLHIPAAHAAPSRDARIAGLSARGRHRTTTPSKLPRRPSAQCRYRKCGSRFRRRPGARGVRLSPRRGGPERGGAAREGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQVRPRATLGWVTSGCPLTVLSLLGRVWTPASVSCWAQGLGADGLWSWMACGVSWCHEVCVTVGTASSPVNRWSLHLPLMGCSGDHMRQFSQSAEIVPGSWCGATVLFCPCTLSGPLPCSLHSICAGLG

SEQ ID NO: 855316 - protein, 232 aa, Homo sapiens
MWMSPICAFPKWGSRAVHLTFLVCYLAGTPTTPKGRPFLGGRQEGSPAPLPPFLGLRSQGLPSPSGYPVTWPLGRGFMPGFGHQLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSSESPPCLRMHPRGSGCVTCAGFSGALSQDSLGNLGVSPSA

SEQ ID NO: 855317 - protein, 1981 aa, Homo sapiens
RFLAWGERGQRSGAPETQPLRTAIFGKKAQGGNAGPHVGTVRGCRVCSPCPRSWEPQEAARDSSLQPLSRLLPRSSHGAALPAAASLLRRGPGSSLHPRGPAPGPRLRLRVSILALKAVMPDSCGLHIPAAHAAPSRDARIAGLSARGRHRTTTPSKLPRRPSAQCRYRKCGSRFRRRPGARGVRLSPRRGGPERGGAAREGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQVRPRATLGWVTSGCPLTVLSLLGRVWTPASGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855318 - protein, 1184 aa, Homo sapiens
MRWCAPVIPATREAETKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855319 - protein, 793 aa, Homo sapiens
AGQHLGLGTRLVVENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855320 - protein, 683 aa, Homo sapiens
MLLWDLPPSLLSVPSCGSGLELEGEPLLLGAVCLQTGTSPTSRSLRSSPRLRGLVSGSRSFRAEARRAESVLPLPTWRHRGGCWWTLGWAEPIACPTPGHSCRRGLCRGHVQAFPASSLPARWMAAVSRALGRLAGLLSLWSGEGWFSEATSGPGPGPAPTSSSPVCVLPDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855321 - protein, 1105 aa, Homo sapiens; identical to SEQ ID NO: 855309

SEQ ID NO: 855322 - protein, 276 aa, Homo sapiens
MKCSLSSVPGAALSAGDPGASDQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 855323 - protein, 1178 aa, Homo sapiens
RFLAWGERGQRSGAPETQPLRTAIFGKKAQGGNAGPHVGTVRGCRVCSPCPRSWEPQEAARDSSLQPLSRLLPRSSHGAALPAAASLLRRGPGSSLHPRGPAPGPRLRLRVSILALKAVMPDSCGLHIPAAHAAPSRDARIAGLSARGRHRTTTPSKLPRRPSAQCRYRKCGSRFRRRPGARGVRLSPRRGGPERGGAAREGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKRYGLRGCAWSRCGVGKDMGLWPA

SEQ ID NO: 855324 - protein, 502 aa, Homo sapiens
RFLAWGERGQRSGAPETQPLRTAIFGKKAQGGNAGPHVGTVRGCRVCSPCPRSWEPQEAARDSSLQPLSRLLPRSSHGAALPAAASLLRRGPGSSLHPRGPAPGPRLRLRVSILALKAVMPDSCGLHIPAAHAAPSRDARIAGLSARGRHRTTTPSKLPRRPSAQCRYRKCGSRFRRRPGARGVRLSPRRGGPERGGAAREGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQVRPRATLGWVTSGCPLTVLSLLGRVWTPASGERLGVLRALFFKVIKDYPSNEDLHERLEVFKALTDNGRHITYLEEELGGCHLGLEVSLALTIKCNLDGKDLGLGRGCRSQGWPAAGMPTLLHAPGLTCVAGVPLRHVLKMQSPGLHPRPADCESLGLGASEHLCNGRSWASSVTGRWCC

SEQ ID NO: 855325 - protein, 130 aa, Homo sapiens
MPDEQGPPLCLWRALALGEQVLACFPVQQDRSSHDATGLPLFGGRLEEMLPGKQSSVPCVPGRGRTQSRAGLRQADGLVWGCGRALPTRPSRLPSRRSESRGAVRIKVLDVLSFVLLINRQFYEVRVQAA

SEQ ID NO: 855326 - protein, 108 aa, Homo sapiens
MNEDTVERIVRCIIQNEANAEALKEMLGDSEGEGTVQLSVWMPPPACRTEPPPIITQCTWALQPLASIAAAARGLHLSVRDAPRKEKAAPGQGRPLCSLWAGGAGAPG

SEQ ID NO: 855327 - protein, 154 aa, Homo sapiens
MLFLLVLVFFLMGLVGFMICHVLKKKGYRCRTSRGSEPDDAQLQPPEDDDMNEDTVERIVRCIIQNEANAEALKEMLGDSEGEGTVQLSVWMPPPACRTEPPPIITQCTWALQPLASIAAAARGLHLSVRDAPRKEKAAPGQGRPLCSLWAGSG

SEQ ID NO: 855328 - protein, 142 aa, Homo sapiens
MLFLLVLVFFLMGLVGFMICHVLKKKGYRCRTSRGSEPDDAQLQPPEDDDMNEDTVERIVRCIIQNEANAEALKEMLGDSEGEGTVQLSEHCPPAEGPALLPPGVAQSQAGGLRRGHSPSVSSPSPACNRLPAPPSPTPRSI

SEQ ID NO: 855329 - protein, 154 aa, Homo sapiens; identical to SEQ ID NO: 855327

SEQ ID NO: 855330 - protein, 120 aa, Homo sapiens
ATGEGIWEARAAAEAISLTQGRSCPEPATALSQPASFSVLPSPRLPRRGYPQPQPGAGEAAKGEGRNQGMSAGRASGALSRTRTPLEPEPQQKPEPEPNHRGRPGGQGGRNQKGRGVREY

SEQ ID NO: 855331 - protein, 417 aa, Homo sapiens
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 855332 - protein, 286 aa, Homo sapiens
MELILSTSPAELTLDPACQPKLPLDSTCQPEMTFNPGPTELTLDPEHQPEETPAPSLAELTLEPVHRRPELLDACADLINDQWPRSRTSRLHSLGQSSDAFPLCLMLLSPHPTLEAAPVVVGHARLSRVLNQPQSLLVETVVVARALRGRGFGRRLMEGLEVFARARGFRKLHLTTHDQVHFYTHLGYQLGEPVQGLVFTSRRLPATLLNAFPTAPSPRPPRKAPNLTAQAAPRGPKGPPLPPPPPLPECLTISPPVPSGPPSKSLLETQYQNVRGRPIFWMEKDI

SEQ ID NO: 855333 - protein, 286 aa, Homo sapiens; identical to SEQ ID NO: 855332

SEQ ID NO: 855334 - protein, 286 aa, Homo sapiens; identical to SEQ ID NO: 855332

SEQ ID NO: 855335 - protein, 417 aa, Homo sapiens; identical to SEQ ID NO: 855331

SEQ ID NO: 855336 - protein, 387 aa, Homo sapiens
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 855337 - protein, 308 aa, Homo sapiens
MQELTLSPGPAKLTPTLDPTHRMELILSTSPAELTLDPACQPKLPLDSTCQPEMTFNPGPTELTLDPEHQPEETPAPSLAELTLEPVHRRPELLDACADLINDQWPRSRTSRLHSLGQSSDAFPLCLMLLSPHPTLEAAPVVVGHARLSRVLNQPQSLLVETVVVARALRGRGFGRRLMEGLEVFARARGFRKLHLTTHDQVHFYTHLGYQLGEPVQGLVFTSRRLPATLLNAFPTAPSPRPPRKAPNLTAQAAPRGPKGPPLPPPPPLPECLTISPPVPSGPPSKSLLETQYQNVRGRPIFWMEKDI

SEQ ID NO: 855338 - protein, 286 aa, Homo sapiens; identical to SEQ ID NO: 855332

SEQ ID NO: 855339 - protein, 286 aa, Homo sapiens; identical to SEQ ID NO: 855332

SEQ ID NO: 855340 - protein, 168 aa, Homo sapiens
MLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 855341 - protein, 569 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 855342 - protein, 569 aa, Homo sapiens; identical to SEQ ID NO: 855341

SEQ ID NO: 855343 - protein, 569 aa, Homo sapiens; identical to SEQ ID NO: 855341

SEQ ID NO: 855344 - protein, 111 aa, Homo sapiens
AELILEDPALMSCCVNSQVGLVAMSPAPSTPLSLLLPAPFLLLCLGGLLAFSLADQNFTKIQNILQFHSLWETFPKRRLPLQPSLSGQAHCRDGGEHIWEAGLPPAGIAAL

SEQ ID NO: 855345 - protein, 569 aa, Homo sapiens; identical to SEQ ID NO: 855341

SEQ ID NO: 855346 - protein, 569 aa, Homo sapiens; identical to SEQ ID NO: 855341

SEQ ID NO: 855347 - protein, 569 aa, Homo sapiens; identical to SEQ ID NO: 855341

SEQ ID NO: 855348 - protein, 447 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEGMCVMEQSKGLLL

SEQ ID NO: 855349 - protein, 569 aa, Homo sapiens; identical to SEQ ID NO: 855341

SEQ ID NO: 855350 - protein, 83 aa, Homo sapiens
AQNLAAHLGADSVRAAHSLNGGPRTPRQDFSPAPSKGHSASPSPAVGSALSLLSHLSHLPFDSSCSHSGGSVGLPSVPSCKRY

SEQ ID NO: 855351 - protein, 128 aa, Homo sapiens
MFNYERPKHFIQSQNPCGSRLQPPGPETSSFSSQTKQSSIIIQPRQCTEQRFSASSTLSSHITMSSSAFPASPQQHAGSNPGQRVTTTYNQSPASFLSSILPSQPDYNSSKIPSAMDSNYQQSSGGNL

SEQ ID NO: 855352 - protein, 135 aa, Homo sapiens
MARRLLGPQNAAAVFQAQDDSGAQDSQQHNSEHARLQVPTSQVRSRSTSRGDVNDQDAIQEKFYPPRFIQVPENMSIDEGRFCRMDFKGVDWQLLMCHGILTGRPSPQMIGHNDRVGKGSSSSWKCRVERVAVCQ

SEQ ID NO: 855353 - protein, 383 aa, Homo sapiens
MDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 855354 - protein, 228 aa, Homo sapiens
MFNYERPKHFIQSQNPCGSRLQPPGPETSSFSSQTKQSSIIIQPRQCTEQRFSASSTLSSHITMSSSAFPASPQQHAGSNPGQRVTTTYNQSPASFLSSILPSQPDYNSSKIPSAMDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVR

SEQ ID NO: 855355 - protein, 623 aa, Homo sapiens
DGQASTSDVTVWQLIKVSGAIIQDRATRLVCEGRRCLFLPFNSGLNPAGTLWNYGNNILQEKVTLPKPGAQYSQDLNKEEQTKVASDSLQPSVIPGLWPQIQGPTLPGTNHYSNNLPSSSIYQLSMFNYERPKHFIQSQNPCGSRLQPPGPETSSFSSQTKQSSIIIQPRQCTEQRFSASSTLSSHITMSSSAFPASPQQHAGSNPGQRVTTTYNQSPASFLSSILPSQPDYNSSKIPSAMDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 855356 - protein, 240 aa, Homo sapiens
MSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 855357 - protein, 149 aa, Homo sapiens
MFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 855358 - protein, 469 aa, Homo sapiens
MFNYERPKHFIQSQNPCGSRLQPPGPETSSFSSQTKQSSIIIQPRQCTEQRFSASSTLSSHITMSSSAFPASPQQHAGSNPGQRVTTTYNQSPASFLSSILPSQPDYNSSKIPSAMDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPCSRACPELCCCECAPLSS

SEQ ID NO: 855359 - protein, 623 aa, Homo sapiens; identical to SEQ ID NO: 855355

SEQ ID NO: 855360 - protein, 383 aa, Homo sapiens; identical to SEQ ID NO: 855353

SEQ ID NO: 855361 - protein, 374 aa, Homo sapiens
MFNYERPKHFIQSQNPCGSRLQPPGPETSSFSSQTKQSSIIIQPRQCTEQRFSASSTLSSHITMSSSAFPASPQQHAGSNPGQRVTTTYNQSPASFLSSILPSQSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 855362 - protein, 314 aa, Homo sapiens
MARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 855363 - protein, 201 aa, Homo sapiens
MIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 855364 - protein, 149 aa, Homo sapiens; identical to SEQ ID NO: 855357

SEQ ID NO: 855365 - protein, 522 aa, Homo sapiens
DGQASTSDVTVWQLIKVSGAIIQDRATRLVCEGRRCLFLPFNSGLNPAGTLWNYGNNILQEKVTLPKPGAQYSQDLNKEEQTKVASDSLQPSVIPGLWPQIQGPTLPGTNHYSNNLPSSSIYQLSMFNYERPKHFIQSQNPCGSRLQPPGPETSSFSSQTKQSSIIIQPRQCTEQRFSASSTLSSHITMSSSAFPASPQQHAGSNPGQRVTTTYNQSPASFLSSILPSQPDYNSSKIPSAMDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRIR

SEQ ID NO: 855366 - protein, 102 aa, Homo sapiens
MFLTALLWRGRIPGRQWIGKHRRPRFVSLRAKQNMIRRLEIEAENHYWLSMPYMTREQERGHAAVRRREAFEAIKAAATSKFPPHRFIADQLDHLNVTKKWS

SEQ ID NO: 855367 - protein, 128 aa, Homo sapiens
ARRVRLRHGVCWRPRRRRVLSSAAGTMFLTALLWRGRIPGRQWIGKHRRPRFVSLRAKQNMIRRLEIEAENHYWLSMPYMTREQERGHAAVRRREAFEAIKAAATSKFPPHRFIADQLDHLNVTKKWS

SEQ ID NO: 855368 - protein, 445 aa, Homo sapiens
MKKGSQQKIFSKAKIPSSSHSPIPSSMSNMRSRSLSPLIGSETLPFHSGGQWCEQVEIADENNMLLDYQDHKGADSHAGVRYITEALIKKLTKQDNLALIKSLNLSLSKDGGKKFKYIENLEKCVKLEVLNLSYNLIGKIEKLDKLLKLRELNLSYNKISKIEGIENMCNLQKLNLAGNEIEHIPVWLGKKLKSLRVLNLKGNKISSLQDISKLKPLQDLISLILVENPVVTLPHYLQFTIFHLRSLESLEGQPVTTQDRQEAFERFSLEEVERLERDLEKKMIETEELKSKQTRFLEEIKNQDKLNKSLKEEAMLQKQSCEELKSDLNTKNELLKQKTIELTRACQKQYELEQELAFYKIDAKFEPLNYYPSEYAEIDKAPDESPYIGKSRYKRNMFATESYIIDSAQAVQIKKMEPDEQLRNDHMNLRGHTPLDTQLEDKEKK

SEQ ID NO: 855369 - protein, 276 aa, Homo sapiens
MKKGSQQKIFSKAKIPSSSHSPIPSSMSNMRSRSLSPLIGSETLPFHSGGQWCEQVEIADENNMLLDYQDHKGADSHAGVRYITEALIKKLTKQDNLALIKSLNLSLSKDGGKKFKYIENLEKCVKLEVLNLSYNLIGKIEKLDKLLKLRELNLSYNKISKIEGIENMCNLQKLNLAGNEIEHIPVWLGKKLKSLRVLNLKGNKISSLQDISKLKPLQDLISLILVENPVVTLPHYLQFTIFHLRSLESLEGQPVTTQDRQEAFERFSLGKIKFKK

SEQ ID NO: 855370 - protein, 445 aa, Homo sapiens; identical to SEQ ID NO: 855368

SEQ ID NO: 855371 - protein, 169 aa, Homo sapiens
RRRGSLPGAGRGRDWCSPGGRKKGEEKQRLSGLASGAAGSLQAVGGRSPASPAVLGARAVGVARPCPRRPRCRPRRSALVLCVAGLPRAPERERVPEQHPRVPARLRGFPAAGGERGRPRAEGGAGKTGLGPGWVLRSSRTSCLLRARIRPSPAARESGMCGTGRCGFG

SEQ ID NO: 855372 - protein, 130 aa, Homo sapiens
EDENICSDTNGKNIRFQNPNLKHGGMAKQSFKAQCQEVRKRKELELQILTEAIRNWEGDDIKTLGNVTYMSQVLIQCAGSEEKNERYLLLFPNVLLMLSASPRMSGFIYQVKHNLNLYFIVDLRIISNWL

SEQ ID NO: 855373 - protein, 646 aa, Homo sapiens
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 855374 - protein, 727 aa, Homo sapiens
SGAGAHFLVREGAEIGAAPEEEKRVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 855375 - protein, 858 aa, Homo sapiens
RRPRPGGGGGRPQVPEPLLRRRLTAGRGARRSGPGRTCWAAPSQSPAPAARWARRRRRRRGPRAGPPLRGEGARPSPPASRAAAMNSAEQTVTWLITLGVLESPKKTISDPEGFLQASLKDGVVLCRLLERLLPGTIEKTFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 855376 - protein, 764 aa, Homo sapiens
WWKVRRSKKTTTSFPISRSGLFGVYYVEVHQPALPWRQEAFFCSRTFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 855377 - protein, 706 aa, Homo sapiens
SGAGAHFLVREGAEIGAAPEEEKRVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEQQAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 855378 - protein, 294 aa, Homo sapiens
MTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 855379 - protein, 144 aa, Homo sapiens
MHNHVLADDDQPSLDSLGRRSSLSRLEPSDLSEDSDYDSIWTAHSYRMGSTSRSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 855380 - protein, 842 aa, Homo sapiens
RRPRPGGGGGRPQVPEPLLRRRLTAGRGARRSGPGRTCWAAPSQSPAPAARWARRRRRRRGPRAGPPLRGEGARPSPPASRAAAMNSAEQTVTWLITLGVLESPKKTISDPEGFLQASLKDGVVLCRLLERLLPGTIEKVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 855381 - protein, 821 aa, Homo sapiens
RRPRPGGGGGRPQVPEPLLRRRLTAGRGARRSGPGRTCWAAPSQSPAPAARWARRRRRRRGPRAGPPLRGEGARPSPPASRAAAMNSAEQTVTWLITLGVLESPKKTISDPEGFLQASLKDGVVLCRLLERLLPGTIEKVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 855382 - protein, 561 aa, Homo sapiens
RRPRPGGGGGRPQVPEPLLRRRLTAGRGARRSGPGRTCWAAPSQSPAPAARWARRRRRRRGPRAGPPLRGEGARPSPPASRAAAMNSAEQTVTWLITLGVLESPKKTISDPEGFLQASLKDGVVLCRLLERLLPGTIEKVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQVKHNLNLYFIVDLRIISNWL

SEQ ID NO: 855383 - protein, 159 aa, Homo sapiens
RRPRPGGGGGRPQVPEPLLRRRLTAGRGARRSGPGRTCWAAPSQSPAPAARWARRRRRRRGPRAGPPLRGEGARPSPPASRAAAMNSAEQTVTWLITLGVLESPKKTISDPEGFLQASLKDGVVLCRLLERLLPGTIEKSCRHCFSLPAGGSQAGACEP

SEQ ID NO: 855384 - protein, 842 aa, Homo sapiens; identical to SEQ ID NO: 855380

SEQ ID NO: 855385 - protein, 772 aa, Homo sapiens
SGAGAHFLVREGAEIGAAPEEEKRVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 855386 - protein, 901 aa, Homo sapiens
RRPRPGGGGGRPQVPEPLLRRRLTAGRGARRSGPGRTCWAAPSQSPAPAARWARRRRRRRGPRAGPPLRGEGARPSPPASRAAAMNSAEQTVTWLITLGVLESPKKTISDPEGFLQASLKDGVVLCRLLERLLPGTIEKVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 855387 - protein, 145 aa, Homo sapiens [sequence omitted]

SEQ ID NO: 855388 - protein, 240 aa, Homo sapiens [sequence omitted]

SEQ ID NO: 855389 - protein, 632 aa, Homo sapiens
RRPRPGGGGGRPQVPEPLLRRRLTAGRGARRSGPGRTCWAAPSQSPAPAARWARRRRRRRGPRAGPPLRGEGARPSPPASRAAAMNSAEQTVTWLITLGVLESPKKTISDPEGFLQASLKDGVVLCRLLERLLPGTIEKVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTVRTWCFSSFQTPGVASRG

SEQ ID NO: 855390 - protein, 632 aa, Homo sapiens; identical to SEQ ID NO: 855389

SEQ ID NO: 855391 - protein, 492 aa, Homo sapiens [sequence omitted]

SEQ ID NO: 855392 - protein, 600 aa, Homo sapiens
RWGRPARPASSGGVRPLLLCSSKKARAALPQVLTFSQRRRARALSGRRLRRRPTLQSPLVAPRPSRCPESGGHEAQPRPPALARPAAAAMSRGPEEVNRLTESTYRNVMEQFNPGLRNLINLGKNYEKAVNAMILAGKAYYDGVAKIGEIATGSPVSTELGHVLIEISSTHKKLNESLDENFKKFHKEIIHELEKKIELDVKYMNATLKRYQTEHKNKLESLEKSQAELKKIRRKSQGSRNALKYEHKEIEYVETVTSRQSEIQKFIADGCKEALLEEKRRFCFLVDKHCGFANHIHYYHLQSAELLNSKLPRWQETCVDAIKVPEKIMNMIEEIKTPASTPVSGTPQASPMIERSNVVRKDYDTLSKCSPKMPPAPSGRAYTSPLIDMFNNPATAAPNSQRVNNSTGTSEDPSLQRSVSVATGLNMMKKQKVKTIFPHTAGSNKTLLSFAQGDVITLLIPEEKDGWLYGEHDVSKARGWFPSSYTKLLEENETEAVTVPTPSPTPVRSISTVNLSENSSVVIPPPDYLECLSMGAAADRRADSARTTSTFKAPASKPETAAPNDANGTAKPPFLSGENPFATVKLRPTVTNDRSAPIIR

SEQ ID NO: 855393 - protein, 600 aa, Homo sapiens; identical to SEQ ID NO: 855392

SEQ ID NO: 855394 - protein, 193 aa, Homo sapiens [sequence omitted]

SEQ ID NO: 855395 - protein, 509 aa, Homo sapiens
RWGRPARPASSGGVRPLLLCSSKKARAALPQVLTFSQRRRARALSGRRLRRRPTLQSPLVAPRPSRCPESGGHEAQPRPPALARPAAAAMSRGPEEVNRLTESTYRNVMEQFNPGLRNLINLGKNYEKAVNAMILAGKAYYDGVAKIGEIATGSPVSTELGHVLIEISSTHKKLNESLDENFKKFHKEIIHELEKKIELDVKYMNATLKRYQTEHKNKLESLEKSQAELKKIRRKSQGSRNALKYEHKEIEYVETVTSRQSEIQKFIADGCKEALLEEKRRFCFLVDKHCGFANHIHYYHLQSAELLNSKLPRWQETCVDAIKVPEKIMNMIEEIKTPASTPVSGTPQASPMIERSNVVRKDYDTLSKCSPKMPPAPSGRAYTSPLIDMFNNPATAAPNSQRVNNSTGTSEDPSLQRSVSVATGLNMMKKQKVKTIFPHTAGSNKTLLSFAQGDVITLLIPEEKDGWLYGEHDVSKARGWFPSSYTKLLEENETEAVTVPTPSLRPTPA

SEQ ID NO: 855396 - protein, 189 aa, Homo sapiens
RWGRPARPASSGGVRPLLLCSSKKARAALPQVLTFSQRRRARALSGRRLRRRPTLQSPLVAPRPSRCPESGGHEAQPRPPALARPAAAAMSRGPEEVNRLTESTYRNVMEQFNPGLRNLINLGKNYEKAVNAMILAGKAYYDGVAKIGEIATGSPVSTELERCQRDCKAAFSQRRKPLCHCETPPDCDE

SEQ ID NO: 855397 - protein, 193 aa, Homo sapiens [sequence omitted]

SEQ ID NO: 855398 - protein, 193 aa, Homo sapiens [sequence omitted]

SEQ ID NO: 855399 - protein, 105 aa, Homo sapiens
EDVWGLVVRHYLTRAVSFLGLSPPTPVRSISTVNLSENSSVVIPPPDYLECLSMGAAADRRADSARTTSTFKAPASKPETAAPVSKAAAGRPGSWTRHPRLGGAG

SEQ ID NO: 855400 - protein, 600 aa, Homo sapiens; identical to SEQ ID NO: 855392

SEQ ID NO: 855401 - protein, 396 aa, Homo sapiens
MEQFNPGLRNLINLGKNYEKAVNAMILAGKAYYDGVAKIGEIATGSPVSTELGHVLIEISSTHKKLNESLDENFKKFHKEIIHELEKKIELDVKYMNATLKRYQTEHKNKLESLEKSQAELKKIRRKSQGSRNALKYEHKEIEYVETVTSRQSEIQKFIADGCKEALLEEKRRFCFLVDKHCGFANHIHYYHLQSAELLNSKLPRWQETCVDAIKVPEKIMNMIEEIKTPASTPVSGTPQASPMIERSNVVRKDYDTLSKCSPKMPPAPSGRAYTSPLIDMFNNPATAAPNSQRVNNSTGTSEDPSLQRSVSVATGLNMMKKQKVKTIFPHTAGSNKTLLSFAQGDVITLLIPEEKDGWLYGEHDVSKARGWFPSSYTKLLEENETEAVTVPTPRC

SEQ ID NO: 855402 - protein, 600 aa, Homo sapiens; identical to SEQ ID NO: 855392

SEQ ID NO: 855403 - protein, 138 aa, Homo sapiens
VQSVHEVWTLEVCSSTLLHPDFSDSRRFGHSGVCMHTRKAIPTPVRSISTVNLSENSSVVIPPPDYLECLSMGAAADRRADSARTTSTFKAPASKPETAAPNDANGTAKPPFLSGENPFATVKLRPTVTNDRSAPIIR

SEQ ID NO: 855404 - protein, 494 aa, Homo sapiens
RWGRPARPASSGGVRPLLLCSSKKARAALPQVLTFSQRRRARALSGRRLRRRPTLQSPLVAPRPSRCPESGGHEAQPRPPALARPAAAAMSRGPEEVNRLTESTYRNVMEQFNPGLRNLINLGKNYEKAVNAMILAGKAYYDGVAKIGEIATGSPVSTELGHVLIEISSTHKKLNESLDENFKKFHKEIIHELEKKIELDVKYMNATLKRYQTEHKNKLESLEKSQAELKKIRRKSQGSRNALKYEHKEIEYVETVTSRQSEIQKFIADGCKEALLEEKRRFCFLVDKHCGFANHIHYYHLQSAELLNSKLPRWQETCVDAIKVPEKIMNMIEEIKTPASTPVSGTPQASPMIERSNVVRKDYDTLSKCSPKMPPAPSGRAYTSPLIDMFNNPATAAPNSQRVNNSTGTSEDPSLQRSVSVATGLNMMKKQKVKTIFPHTAGSNKTLLSFAQGDVITLLIPEEKDGWLYGEHDVSKASLSYRMLKNETNMPPPR

SEQ ID NO: 855405 - protein, 374 aa, Homo sapiens
RWGRPARPASSGGVRPLLLCSSKKARAALPQVLTFSQRRRARALSGRRLRRRPTLQSPLVAPRPSRCPESGGHEAQPRPPALARPAAAAMSRGPEEVNRLTESTYRNVMEQFNPGLRNLINLGKNYEKAVNAMILAGKAYYDGVAKIGEIATGSPVSTELGHVLIEISSTHKKLNESLDENFKKFHKEIIHELEKKIELDVKYMNATLKRYQTEHKNKLESLEKSQAELKKIRRKSQGSRNALKYEHKEIEYVETVTSRQSEIQKFIADGCKEALLEEKRRFCFLVDKHCGFANHIHYYHLQSAELLNSKLPRWQETCVDAIKVPEKIMNMIEEIKTPASTPVSGTPQASPMIERSNVVGASFLFQISIVCFLT

SEQ ID NO: 855406 - protein, 69 aa, Homo sapiens
TSEDPSLQRSVSVATGLNMMKKQKVKTIFPHTAGSNKTLLSFAQGDVITLLIPEEKDGWLYGEHDVSKA

SEQ ID NO: 855407 - protein, 88 aa, Homo sapiens
MSSEPPPPYPGGPTAPLLEEKSGAPPTPGRSSPAVMQPPPGMPLDSVTVAWPPKACQNTTSLTHCYPTTIKGLRKKAYPGFSLAVCNP

SEQ ID NO: 855408 - protein, 208 aa, Homo sapiens
MSSEPPPPYPGGPTAPLLEEKSGAPPTPGRSSPAVMQPPPGMPLPPADIGPPPYEPPGHPMPQPGFIPPHMSADGTYMPPGFYPPPGPHPPMGYYPPGPYTPGPYPGPGGHTATVLVPSGAATTVTVLQGEIFEGAPVQTVCPHCQQAITTKISYEIGLMNFVLGFFCCFMGCDLGCCLIPCLINDFKDVTHTCPSCKAYIYTYKRLC

SEQ ID NO: 855409 - protein, 208 aa, Homo sapiens; identical to SEQ ID NO: 855408

SEQ ID NO: 855410 - protein, 208 aa, Homo sapiens; identical to SEQ ID NO: 855408

SEQ ID NO: 855411 - protein, 173 aa, Homo sapiens
MQPPPGMPLPPADIGPPPYEPPGHPMPQPGFIPPHMSADGTYMPPGFYPPPGPHPPMGYYPPGPYTPGPYPGPGGHTATVLVPSGAATTVTVLQGEIFEGAPVQTVCPHCQQAITTKISYEIGLMNFVLGFFCCFMGCDLGCCLIPCLINDFKDVTHTCPSCKAYIYTYKRLC

SEQ ID NO: 855412 - protein, 129 aa, Homo sapiens
MSSEPPPPYPGGPTAPLLEEKSGAPPTPGRSSPAVMQPPPGAATTVTVLQGEIFEGAPVQTVCPHCQQAITTKISYEIGLMNFVLGFFCCFMGCDLGCCLIPCLINDFKDVTHTCPSCKAYIYTYKRLC

SEQ ID NO: 855413 - protein, 208 aa, Homo sapiens; identical to SEQ ID NO: 855408

SEQ ID NO: 855414 - protein, 208 aa, Homo sapiens; identical to SEQ ID NO: 855408

SEQ ID NO: 855415 - protein, 183 aa, Homo sapiens
MSSEPPPPYPGGPTAPLLEEKSGAPPTPGGHAAPSCAWRSRTHGHDRQHRVETTPGQDLCHNRRHTSRAHTHETQDPQTRHHNNQGQDKKSKTQEHTTQTTRQDTNTTTTTSTQPTHQDAQTHTPQHHTHHATQKRQRRHDDQQKANKQRHTPTSESPQTRTEREEKRRRAETTPPTKQHKHN

SEQ ID NO: 855416 - protein, 208 aa, Homo sapiens; identical to SEQ ID NO: 855408

SEQ ID NO: 855417 - protein, 173 aa, Homo sapiens; identical to SEQ ID NO: 855411

SEQ ID NO: 855418 - protein, 208 aa, Homo sapiens; identical to SEQ ID NO: 855408

SEQ ID NO: 855419 - protein, 69 aa, Homo sapiens
GGVGGGLGGFVVRAKPRGAEGLVLPAPVRTRAPLRFRPASGTGLLELPEPCLFPVHPGQQLKEPHLPHQ

SEQ ID NO: 855420 - protein, 34 aa, Homo sapiens
IESYGHGIAQSHDCHASMAAVTEALRDVFILCFK

SEQ ID NO: 855421 - protein, 196 aa, Homo sapiens
QALYLDLLLRSAFCLILFSGCFQGLSSVMALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPETMKQIKQYFNGPNVA

SEQ ID NO: 855422 - protein, 153 aa, Homo sapiens
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPE

SEQ ID NO: 855423 - protein, 262 aa, Homo sapiens
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 855424 - protein, 262 aa, Homo sapiens; identical to SEQ ID NO: 855423

SEQ ID NO: 855425 - protein, 283 aa, Homo sapiens
MNLNGRWQGVISGCFQGLSSVMALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 855426 - protein, 262 aa, Homo sapiens; identical to SEQ ID NO: 855423

SEQ ID NO: 855427 - protein, 168 aa, Homo sapiens
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPETMKQIKQYFNGPNVA

SEQ ID NO: 855428 - protein, 218 aa, Homo sapiens
MAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 855429 - protein, 210 aa, Homo sapiens
MALGLKCFRMVHPTFRNYLAASIRPVSEVTLKTVHERQHGHRQYMAYSAVPVRHFATKKAKGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 855430 - protein, 110 aa, Homo sapiens
MCTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 855431 - protein, 307 aa, Homo sapiens
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQAPITVVLPVSRLHTCCFLCLALSSPPYLASPVYHQALSWISRPLGSLLFPSNLGPSLPALIAQSTALYEF

SEQ ID NO: 855432 - protein, 174 aa, Homo sapiens
MNLNGRWQGVISGCFQGLSSVMALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPE

SEQ ID NO: 855433 - protein, 153 aa, Homo sapiens; identical to SEQ ID NO: 855422

SEQ ID NO: 855434 - protein, 262 aa, Homo sapiens; identical to SEQ ID NO: 855423

SEQ ID NO: 855435 - protein, 283 aa, Homo sapiens; identical to SEQ ID NO: 855425

SEQ ID NO: 855436 - protein, 290 aa, Homo sapiens
QALYLDLLLRSAFCLILFSGCFQGLSSVMALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 855437 - protein, 262 aa, Homo sapiens; identical to SEQ ID NO: 855423

SEQ ID NO: 855438 - protein, 124 aa, Homo sapiens
MAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPETMKQIKQYFNGPNVA

SEQ ID NO: 855439 - protein, 204 aa, Homo sapiens
QALYLDLLLRSAFCLILFSGCFQGLSSVMALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPEELAWIRSLRVPGIRSHLYHQLAV

SEQ ID NO: 855440 - protein, 132 aa, Homo sapiens
YTWMSYGVDSVYLKLSPQPVNEEMKSVIEALKDNFNKTLNIRTSPGSLDKIAVVTADGKLALNQISQISMKSPQLILVNMASFPESNQRAQRNAGETGQTEHQQGQRLFTEGSHQLNEQAEEIQGYSLRGHH

SEQ ID NO: 855441 - protein, 108 aa, Homo sapiens
MYAYFYFALVPYVLRTRKECEYLLWIERFSRLAVGSMKVTKVSHTAPALWVDFTSSTPLTYAELPCGQARPSSLITPRPRSHSNKCLSLCPCCWQAEVPWQPLNIAEC

SEQ ID NO: 855442 - protein, 243 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLQAHLSIGDDPGPLSAERSRHPVSRRTSSSHWYCVARPPRTAAGVPADGGTASGVRPLLAPRASRSPRSCVQ

SEQ ID NO: 855443 - protein, 190 aa, Homo sapiens
SSRREAGGSAWPCVERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKVWRGLCAETYGWGSPRMDPVRLW

SEQ ID NO: 855444 - protein, 366 aa, Homo sapiens
MSPVGWRLGVAVRERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVGDQLWGTKNLIPGKVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 855445 - protein, 253 aa, Homo sapiens
MSPVGWRLGVAVRERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVG

SEQ ID NO: 855446 - protein, 382 aa, Homo sapiens
MSPVGWRLGVAVRERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSQPSPPPELTWEVLKGHWATVSKGKRADHAGR

SEQ ID NO: 855447 - protein, 352 aa, Homo sapiens
MSPVGWRLGVAVRERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 855448 - protein, 352 aa, Homo sapiens; identical to SEQ ID NO: 855447

SEQ ID NO: 855449 - protein, 352 aa, Homo sapiens; identical to SEQ ID NO: 855447

SEQ ID NO: 855450 - protein, 352 aa, Homo sapiens; identical to SEQ ID NO: 855447

SEQ ID NO: 855451 - protein, 352 aa, Homo sapiens; identical to SEQ ID NO: 855447

SEQ ID NO: 855452 - protein, 358 aa, Homo sapiens
MSPVGWRLGVAVRERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRAWGRLAALTLVAQCASRVGLGRELSLGWAAWGLA

SEQ ID NO: 855453 - protein, 353 aa, Homo sapiens
MSPVGWRLGVAVRERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSEWAGLLGAWHRVERATLGL

SEQ ID NO: 855454 - protein, 289 aa, Homo sapiens
SSRREAGGSAWPCVERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKVSNLFLGPRPQSYILSTCSC

SEQ ID NO: 855455 - protein, 217 aa, Homo sapiens
MSPVGWRLGVAVRERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNTFARGIL

SEQ ID NO: 855456 - protein, 190 aa, Homo sapiens; identical to SEQ ID NO: 855443

SEQ ID NO: 855457 - protein, 238 aa, Homo sapiens
MSPVGWRLGVAVRERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLQAHLSIGDDPGPLSAERSRHPVSRRTSSSHWYCVARPPRTAAGVPADGGTASGVRPLLAPRASRSPRSCVQ

SEQ ID NO: 855458 - protein, 371 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 855459 - protein, 352 aa, Homo sapiens; identical to SEQ ID NO: 855447

SEQ ID NO: 855460 - protein, 360 aa, Homo sapiens
MSPVGWRLGVAVRERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNKWVGCVCIIRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 855461 - protein, 190 aa, Homo sapiens; identical to SEQ ID NO: 855443

SEQ ID NO: 855462 - protein, 352 aa, Homo sapiens; identical to SEQ ID NO: 855447

SEQ ID NO: 855463 - protein, 108 aa, Homo sapiens
MSPVGWRLGVAVLLNDRACLGLTLWRHHTALSLSLSMAPPNPNAQRSLPTTMWDSTINLASSHCFSSRTCRKSFRTLCGFMWMPLEWKREPLCSLWDISTHLWTSLQT

SEQ ID NO: 855464 - protein, 118 aa, Homo sapiens
SSRREAGGSAWPCVERPCVTGTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLK

SEQ ID NO: 855465 - protein, 105 aa, Homo sapiens
AQAGLELLVSSDPPILASQSAGITGVSHCAWLPETMLLLGSFSWFISSALLNKFSQMIGVLGDRSSLKTEASHHTYISSPWWQMEKKDLPLHFSPLTPLSGVGRN

SEQ ID NO: 855466 - protein, 744 aa, Homo sapiens
MDFSKFLADDFDVKEWINAAFRAGSKEAASGKADGHAATLVMKLQLFIQEVNHAVEETSHQALQNMPKVLRDVEALKQEASFLKEQMILVKEDIKKFEQDTSQSMQVLVEIDQVKSRMQLAAESLQEADKWSTLSADIEETFKTQDIAVISAKLTGMQNSLMMLVDTPDYSEKCVHLEALKNRLEALASPQIVAAFTSQAVDQSKVFVKVFTEIDRMPQLLAYYYKCHKVQLLAAWQELCQSDLSLDRQLTGLYDALLGAWHTQIQWATQVFQKPHEVVMVLLIQTLGALMPSLPSCLSNGVERAGPEQELTRLLEFYDATAHFAKGLEMALLPHLHEHNLVKVTELVDAVYDPYKPYQLKYGDMEESNLLIQMSAVPLEHGEVIDCVQELSHSVNKLFGLASAAVDRCVRFTNGLGTCGLLSALKSLFAKYVSDFTSTLQSIRKKCKLDHIPPNSLFQEDWTAFQNSIRIIATCGELLRHCGDFEQQLANRILSTAGKYLSDSCSPRSLAGFQESILTDKKNSAKNPWQEYNYLQKDNPAEYASLMEILYTLKEKGSSNHNLLAAPRAALTRLNQQAHQLAFDSVFLRIKQQLLLISKMDSWNTAGIGETLTDELPAFSLTPLEYISNIGQYIMSLPLNLEPFVTQEDSALELALHAGKLPFPPEQGDELPELDNMADNWLGSIARATMQTYCDAILQIPELSPHSAKQLATDIDYLINVMDALGLQPSRTLQHIVTLLKTQA

SEQ ID NO: 855467 - protein, 388 aa, Homo sapiens
ELAPRSMAMEESNLLIQMSAVPLEHGEVIDCVQELSHSVNKLFGLASAAVDRCVRFTNGLGTCGLLSALKSLFAKYVSDFTSTLQSIRKKCKLDHIPPNSLFQEDWTAFQNSIRIIATCGELLRHCGDFEQQLANRILSTAGKYLSDSCSPRSLAGFQESILTDKKNSAKNPWQEYNYLQKDNPAEYASLMEILYTLKEKGSSNHNLLAAPRAALTRLNQQAHQLAFDSVFLRIKQQLLLISKMDSWNTAGIGETLTDELPAFSLTPLEYISNIGQYIMSLPLNLEPFVTQEDSALELALHAGKLPFPPEQGDELPELDNMADNWLGSIARATMQTYCDAILQIPELSPHSAKQLATDIDYLINVMDALGLQPSRTLQHIVTLLKTQA

SEQ ID NO: 855468 - protein, 524 aa, Homo sapiens
MGFRHVDQAGLKLLGWSNLPTSAIQSTGITGLSHCTQPPFATFFGASDKENLNRSSRARGRDAILIITEKEESNEKHYGSSRQTFDHAFLPGVNFHDPTDDLDCSPLIQALEKHSNVGTIFLTSLLSDFTTDEKAWRSSPISALSVLKPNAALSVFADQEHGEVIDCVQELSHSVNKLFGLASAAVDRCVRFTNGLGTCGLLSALKSLFAKYVSDFTSTLQSIRKKCKLDHIPPNSLFQEDWTAFQNSIRIIATCGELLRHCGDFEQQLANRILSTAGKYLSDSCSPRSLAGFQESILTDKKNSAKNPWQEYNYLQKDNPAEYASLMEILYTLKEKGSSNHNLLAAPRAALTRLNQQAHQLAFDSVFLRIKQQLLLISKMDSWNTAGIGETLTDELPAFSLTPLEYISNIGQYIMSLPLNLEPFVTQEDSALELALHAGKLPFPPEQGDELPELDNMADNWLGSIARATMQTYCDAILQIPELSPHSAKQLATDIDYLINVMDALGLQPSRTLQHIVTLLKTQA

SEQ ID NO: 855469 - protein, 638 aa, Homo sapiens
MDFSKFLADDFDVKEWINAAFRAGSKEAASGKADGHAATLVMKLQLFIQEVNHAVEETSHQALQNMPKVLRDVEALKQEASFLKEQMILVKEDIKKFEQDTSQSMQVLVEIDQVKSRMQLAAESLQEADKWSTLSADIEETFKTQDIAVISAKLTGMQNSLMMLVDTPDYSEKCVHLEALKNRLEALASPQIVAAFTSQAVDQSKVFVKVFTEIDRMPQLLAYYYKCHKVQLLAAWQELCQSDLSLDRQLTGLYDALLGAWHTQIQWATQVFQKPHEVVMVLLIQTLGALMPSLPSCLSNGVERAGPEQELTRLLEFYDATAHFAKGLEMALLPHLHEHNLVKVTELVDAVYDPYKPYQLKYGDMEESNLLIQMSAVPLEHGEVIDCVQELSHSVNKLFGLASAAVDRCVRFTNGLGTCGLLSALKSLFAKYVSDFTSTLQSIRKKCKLDHIPPNSLFQEDWTAFQNSIRIIATCGELLRHCGDFEQQLANRILSTAGKYLSDSCSPRSLAGFQESILTDKKNSAKNPWQEYNYLQKDNPAEYASLMEILYTLKEKGSSNHNLLAAPRAALTRLNQQAHQLAFDSVFLRIKQQLLLISKMDVSFSLTTSIFPGSCLQLKHTECGLNPPCSKSFGKIPL

SEQ ID NO: 855470 - protein, 393 aa, Homo sapiens [sequence omitted]

SEQ ID NO: 855471 - protein, 105 aa, Homo sapiens
TYVDVPNKVPFVLSLQVQLLAAWQELCQSDLSLDRQLTGLYDALLGAWHTQIQWATQVTAHFCSRENRVCGDKGTGDCLGSGHPQLQSTAQRTSPFVAVIQGVKK

SEQ ID NO: 855472 - protein, 110 aa, Homo sapiens
MSLPLNLEPFVTQEDSALELALHAGKLPFPPEQGDELPELDNMADNWLGSIARATMQTYCDAILQIPELSPHSAKQLATDIDYLINVMDALGLQPSRTLQHIVTLLKTQA

SEQ ID NO: 855473 - protein, 744 aa, Homo sapiens; identical to SEQ ID NO: 855466

SEQ ID NO: 855474 - protein, 738 aa, Homo sapiens
AQAGLELLVSSDPPILASQSAGITGVSHCAWLPETMLLLGSFSWFISSALLNKFSQMIGVLGDRSSLKTEASHHTYISSPWWQMEKKDLPLHFSPLTLFQVLVEIDQVKSRMQLAAESLQEADKWSTLSADIEETFKTQDIAVISAKLTGMQNSLMMLVDTPDYSEKCVHLEALKNRLEALASPQIVAAFTSQAVDQSKVFVKVFTEIDRMPQLLAYYYKCHKVQLLAAWQELCQSDLSLDRQLTGLYDALLGAWHTQIQWATQVFQKPHEVVMVLLIQTLGALMPSLPSCLSNGVERAGPEQELTRLLEFYDATAHFAKGLEMALLPHLHEHNLVKVTELVDAVYDPYKPYQLKYGDMEESNLLIQMSAVPLEHGEVIDCVQELSHSVNKLFGLASAAVDRCVRFTNGLGTCGLLSALKSLFAKYVSDFTSTLQSIRKKCKLDHIPPNSLFQEDWTAFQNSIRIIATCGELLRHCGDFEQQLANRILSTAGKYLSDSCSPRSLAGFQESILTDKKNSAKNPWQEYNYLQKDNPAEYASLMEILYTLKEKGSSNHNLLAAPRAALTRLNQQAHQLAFDSVFLRIKQQLLLISKMDSWNTAGIGETLTDELPAFSLTPLEYISNIGQYIMSLPLNLEPFVTQEDSALELALHAGKLPFPPEQGDELPELDNMADNWLGSIARATMQTYCDAILQIPELSPHSAKQLATDIDYLINVMDALGLQPSRTLQHIVTLLKTQA

SEQ ID NO: 855475 - protein, 452 aa, Homo sapiens
MCIALVLDVKWIFDHAFLPGVNFHDPTDDLDCSPLIQALEKHSNVGTIFLTSLLSDFTTDEKAWRSSPISALSVLKPNAALSVFADQEHGEVIDCVQELSHSVNKLFGLASAAVDRCVRFTNGLGTCGLLSALKSLFAKYVSDFTSTLQSIRKKCKLDHIPPNSLFQEDWTAFQNSIRIIATCGELLRHCGDFEQQLANRILSTAGKYLSDSCSPRSLAGFQESILTDKKNSAKNPWQEYNYLQKDNPAEYASLMEILYTLKEKGSSNHNLLAAPRAALTRLNQQAHQLAFDSVFLRIKQQLLLISKMDSWNTAGIGETLTDELPAFSLTPLEYISNIGQYIMSLPLNLEPFVTQEDSALELALHAGKLPFPPEQGDELPELDNMADNWLGSIARATMQTYCDAILQIPELSPHSAKQLATDIDYLINVMDALGLQPSRTLQHIVTLLKTQA

SEQ ID NO: 855476 - protein, 110 aa, Homo sapiens; identical to SEQ ID NO: 855472

SEQ ID NO: 855477 - protein, 34 aa, Homo sapiens
KLQLFIQEVNHAVEGEPLGALAAGPSPALGWAEV

SEQ ID NO: 855478 - protein, 686 aa, Homo sapiens
MINNSQCHKQGDFPYQVGTELSIQISEDENYIVNKADGPNNTGNPEFPILRTQDSWRKTFLTESQRLNRDQQISIKNKLCQCKKGVDPIGWISHHDGHRVHKSEKSYRPNDYEKDNMKILTFDHNSMIHTGQKSYQCNECKKPFSDLSSFDLHQQLQSGEKSLTCVERGKGFCYSPVLPVHQKVHVGEKLKCDECGKEFSQGAHLQTHQKVHVIEKPYKCKQCGKGFSRRSALNVHCKVHTAEKPYNCEECGRAFSQASHLQDHQRLHTGEKPFKCDACGKSFSRNSHLQSHQRVHTGEKPYKCEECGKGFICSSNLYIHQRVHTGEKPYKCEECGKGFSRPSSLQAHQGVHTGEKSYICTVCGKGFTLSSNLQAHQRVHTGEKPYKCNECGKSFRRNSHYQVHLVVHTGEKPYKCEICGKGFSQSSYLQIHQKAHSIEKPFKCEECGQGFNQSSRLQIHQLIHTGEKPYKCEECGKGFSRRADLKIHCRIHTGEKPYNCEECGKVFRQASNLLAHQRVHSGEKPFKCEECGKSFGRSAHLQAHQKVHTGDKPYKCDECGKGFKWSLNLDMHQRVHTGEKPYKCGECGKYFSQASSLQLHQSVHTGEKPYKCDVCGKVFSRSSQLQSHQRVHTGEKPYKCEICGKSFSWRSNLTVHHRIHVGDKSYKSNRGGKNIRESTQEKKSIK

SEQ ID NO: 855479 - protein, 686 aa, Homo sapiens; identical to SEQ ID NO: 855478

SEQ ID NO: 855480 - protein, 686 aa, Homo sapiens; identical to SEQ ID NO: 855478

SEQ ID NO: 855481 - protein, 686 aa, Homo sapiens; identical to SEQ ID NO: 855478

SEQ ID NO: 855482 - protein, 686 aa, Homo sapiens; identical to SEQ ID NO: 855478

SEQ ID NO: 855483 - protein, 686 aa, Homo sapiens; identical to SEQ ID NO: 855478

SEQ ID NO: 855484 - protein, 686 aa, Homo sapiens; identical to SEQ ID NO: 855478

SEQ ID NO: 855485 - protein, 686 aa, Homo sapiens; identical to SEQ ID NO: 855478

SEQ ID NO: 855486 - protein, 686 aa, Homo sapiens; identical to SEQ ID NO: 855478

SEQ ID NO: 855487 - protein, 686 aa, Homo sapiens; identical to SEQ ID NO: 855478

SEQ ID NO: 855488 - protein, 189 aa, Homo sapiens
VGVVCYRVYCCCCLANVSLPGIGGTIPESKPFFYVNVADIESLEVEVSYVACTTEKIFEEKRELYDVYVDNQNVKTHHDHLQPLLKINSADREKYRRLNEQRQMLLYSQEVEEDYNPCEEDLFVLFFLEQNNRIFQTLLEVSASQDKTLTAEHARGMGLDPQGDRSFLLDLLEAYGIDVMLVIDNPCCP

SEQ ID NO: 855489 - protein, 102 aa, Homo sapiens
VEVSYVACEYGALPSSCPQVPALLLPDTGLLGALFPSGVGWVPTSLTPGSTGTTEKIFEEKRELYDVYVDNQNVKTHHDHLQPLLKINSADREKYRRLNEQR

SEQ ID NO: 855490 - protein, 189 aa, Homo sapiens; identical to SEQ ID NO: 855488

SEQ ID NO: 855491 - protein, 231 aa, Homo sapiens
MSGEENPASKPTPVQDVQGDGRWMSLHHRFVADSKDKEPEVVFIGDSLVQLMHQCEIWRELFSPLHALNFGIGGDGTQHVLWRLENGELEHIRPKIVVVWVGTNNHGHTAEQVTGGIKAIVQLVNERQPQARVVVLGLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 855492 - protein, 231 aa, Homo sapiens; identical to SEQ ID NO: 855491

SEQ ID NO: 855493 - protein, 231 aa, Homo sapiens; identical to SEQ ID NO: 855491

SEQ ID NO: 855494 - protein, 218 aa, Homo sapiens
MSGEENPASKPTPVQDVQGDGRWMSLHHRFVADSKDKEPEVVFIGDSLVQLMHQCEIWRELFSPLHALNFGIGGDGTQHVLWRLENGELEHIRPKIVVVWVGTNNHGHTAEQVTGGIKAIVQLGLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 855495 - protein, 207 aa, Homo sapiens
MSGEENPASKPTPVQDVQGDGRWMSLHHRFVADSKDKEPEVVFIGDSLVQLMHQCEIWRELFSPLHALNFGIGGDGTQHVLWRLENGELEHIRPKIVVVWVGTNNHGHTAEQGLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 855496 - protein, 218 aa, Homo sapiens; identical to SEQ ID NO: 855494

SEQ ID NO: 855497 - protein, 123 aa, Homo sapiens
GGRYGLGGRYGLDATSHLLCCVSVVVGAGLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 855498 - protein, 54 aa, Homo sapiens
EENPASKPTPVQDVQGDGRWMSLVSVPTWDIEESGGAGGGSGERLVRATLLPDW

SEQ ID NO: 855499 - protein, 207 aa, Homo sapiens; identical to SEQ ID NO: 855495

SEQ ID NO: 855500 - protein, 231 aa, Homo sapiens; identical to SEQ ID NO: 855491

SEQ ID NO: 855501 - protein, 231 aa, Homo sapiens; identical to SEQ ID NO: 855491

SEQ ID NO: 855502 - protein, 218 aa, Homo sapiens; identical to SEQ ID NO: 855494

SEQ ID NO: 855503 - protein, 108 aa, Homo sapiens
MLVSLLRLVFLLQGLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 855504 - protein, 103 aa, Homo sapiens
MSGEENPASKPTPVQDVQGDGRWMSLHHRFVADSKDKEPEVVFIGDSLVQLMHQCEIWRELFSPLHALNFGIGGDGTQHVLWRLENGELEHIRPKVSGAWVGL

SEQ ID NO: 855505 - protein, 180 aa, Homo sapiens
MGLTVSALFSRIFGKKQMRILMVGLDAAGKTTILYKLKLGEIVTTIPTIGFNVETVEYKNICFTVWDVGGQDKIRPLWRHYFQNTQGLIFVVDSNDRERVQESADELQKMLQEDELRDAVLLVFANKQDMPNAMPVSELTDKLGLQHLRSRTWYVQATCATQGTGLYDGLDWLSHELSKR

SEQ ID NO: 855506 - protein, 180 aa, Homo sapiens; identical to SEQ ID NO: 855505

SEQ ID NO: 855507 - protein, 132 aa, Homo sapiens
RGGGGGASSCCCCAPSPRGRPVPARTPRRCPRPSPGPAMGLTVSALFSRIFGKKQMRILMVGLDAAGKTTILYKLKLGEIVTTIPTIGFNVETVEYKNICFTVWDVGGQDKIRPLWRHYFQNTQVECWEGTF

SEQ ID NO: 855508 - protein, 180 aa, Homo sapiens; identical to SEQ ID NO: 855505

SEQ ID NO: 855509 - protein, 96 aa, Homo sapiens
ARRRRRSLLLLLLRPIPPRPASSSPHPASVPAPLPGPRHGPHRVRALFADLREEADADSHGWLGCGWQDHNPVQTEVGGDCHHHPNHRLQCRNSGI

SEQ ID NO: 855510 - protein, 170 aa, Homo sapiens
MGLTVSALFSRIFGKKQMRILMVGLDAAGKTTILYKLKLGEIVTTIPTIGFNVETVEYKNICFTVWDVGGQDKIRPLWRHYFQNTQGLIFVVDSNDRERVIPGMHAGASGHQGPAPGWLRFDSSWDSQSRPSYRPVPWVAQVAWTYHVRLRKCCSPSLSVSSLTGMALGM

SEQ ID NO: 855511 - protein, 84 aa, Homo sapiens
VVASPFPWSLGGSLAPISIPVPLSVAVGLDAAGKTTILYKLSVLEVVPPQRPNLVLASHVPDCETDVLIFHCFYIEAYGWDGGD

SEQ ID NO: 855512 - protein, 132 aa, Homo sapiens; identical to SEQ ID NO: 855507

SEQ ID NO: 855513 - protein, 98 aa, Homo sapiens
VVASPFPWSLGGSLAPISIPVPLSVAVGLDAAGKTTILYKLKLGEIVTTIPTIGFNVETVEYKNICFTVWDVGGQDKIRPLWRHYFQNTQVECWEGTF

SEQ ID NO: 855514 - protein, 132 aa, Homo sapiens; identical to SEQ ID NO: 855507

SEQ ID NO: 855515 - protein, 95 aa, Homo sapiens
MGLTVSALFSRIFGKKQMRILMGEADRARGPDRGAGPGAALPPPRPSSPAHLGLWPRVTHLITPRGLCSRAGPGLHRRPRGLTPGAAGLGGVKLP

SEQ ID NO: 855516 - protein, 50 aa, Homo sapiens
MQLSETNRTLFLFGVTKYTAGPYECEIWNSGSASRSDPVTLNLLREYLLF

SEQ ID NO: 855517 - protein, 369 aa, Homo sapiens
FFAGGRTAQLTAVLWKLLDPRLISTEENMHAAEIMGPLSAPPCTEHIKWKGLLLTALLLNFWNLPTTAQVMIEAQPPKVSEGKDVLLLVHNLPQNLTGYIWYKGQIRDLYHYITSYIVDGQIIIYGPAYSGRETVYSNASLLIQNVTREDAGSYTLHIIKRGDGTRGVTGYFTFTLYLETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIAPPGLGTFAFNNPT

SEQ ID NO: 855518 - protein, 247 aa, Homo sapiens
FFAGGRTAQLTAVLWKLLDPRLISTEENMHAAEIMGPLSAPPCTEHIKWKGLLLTVETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIAPPGLGTFAFNNPT

SEQ ID NO: 855519 - protein, 389 aa, Homo sapiens
FFAGGRTAQLTAVLWKLLDPRLISTEENMHAAEIMGPLSAPPCTEHIKWKGLLLTALLLNFWNLPTTAQVMIEAQPPKVSEGKDVLLLVHNLPQNLTGYIWYKGQIRDLYHYITSYIVDGQIIIYGPAYSGRETVYSNASLLIQNVTREDAGSYTLHIIKRGDGTRGVTGYFTFTLYLETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIESCFDSSSKYLKSATVQNCFFFKEIYGKDYEKDS

SEQ ID NO: 855520 - protein, 113 aa, Homo sapiens
MWWMLAREVLRMRGTISREHPWEVMPDLYFYRDPEEIEKEEQAAAEKAVTKEEFQGEWTAPAPEFTATQPEVADWSEGVQVPSVPIQLFPTEDWSAQPATEDWSAAPTAQATG

SEQ ID NO: 855521 - protein, 369 aa, Homo sapiens; identical to SEQ ID NO: 855517

SEQ ID NO: 855522 - protein, 235 aa, Homo sapiens
SQPLPAQSTSNGRGSWSQNVTREDAGSYTLHIIKRGDGTRGVTGYFTFTLYLETPKPSISSSNLNPREAMETVILTCDPETPDTSYQWWMNGQSLPMTHRFQLSETNRTLFLFGVTKYTAGPYECEIRNSGSASRSDPVTLNLLHGPDLPRIHPSYTNYRSGDNLYLSCFANSNPPAQYSWTINGKFQQSGQNLFIPQITTKHSGLYVCSVRNSATKDTGEARTPGEARTLARLG

SEQ ID NO: 855523 - protein, 79 aa, Homo sapiens
GRTAQLTAVLWKLLDPRLISTEENMHAAEIMGPLSAPPCTEHIKWKGLLLTGEERTSWERTGGGSRVTGWGLLERLLGF

SEQ ID NO: 855524 - protein, 369 aa, Homo sapiens; identical to SEQ ID NO: 855517

SEQ ID NO: 855525 - protein, 367 aa, Homo sapiens
FFAGGRTAQLTAVLWKLLDPRLISTEENMHAAEIMGPLSAPPCTEHIKWKGLLLTALLLNFWNLPTTAQVMIEAQPPKVSEGKDVLLLVHNLPQNLTGYIWYKGQIRDLYHYITSYIVDGQIIIYGPAYSGRETVYSNASLLIQNVTREDAGSYTLHIIKRGDGTRGVTGYFTFTLYLETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIGPCHGDLTECHS

SEQ ID NO: 855526 - protein, 367 aa, Homo sapiens; identical to SEQ ID NO: 855525

SEQ ID NO: 855527 - protein, 242 aa, Homo sapiens
SQPLPAQSTSNGRGSWSQNVTREDAGSYTLHIIKRGDGTRGVTGYFTFTLYLETPKPSISSSNLNPREAMETVILTCDPETPDTSYQWWMNGQSLPMTHRFQLSETNRTLFLFGVTKYTAGPYECEIRNSGSASRSDPVTLNLLHGPDLPRIHPSYTNYRSGDNLYLSCFANSNPPAQYSWTINGKFQQSGQNLFIPQITTKHSGLYVCSVRNSATHQWRGKLHIVDSQSLCFYKNRTSSSP

SEQ ID NO: 855528 - protein, 121 aa, Homo sapiens
MAWMPPPFLPHTYYHTREVPKLSCLTDTHPLAEHSWLIDGKFQQSAQVFFIPQITKTYRGLYVCFIHNSATAGTNLIIKRTIVPGKWIPETLAICFPVKSISYQGGETLEERARLNVMPAD

SEQ ID NO: 855529 - protein, 218 aa, Homo sapiens
MSCSGSGADPEAAPASAASAPGPAPPVSAPAALPSSTAAENKASPAGTAGGPGAGAAAGGTGPLAARAGEPAERRGAAPVSAGGAAPPEGAISNGVYVLPSAANGDVKPVVSSTPLVDFLMQLEDYTPTIPDAVTGYYLNRAGFEASDPRIIRLISLAAQKFISDIANDALQHCKMKGTASGSSRSKSKDRKYTLTMEDLTPALSEYGINVKKPHYFT

SEQ ID NO: 855530 - protein, 313 aa, Homo sapiens
MSCSGSGADPEAAPASAASAPGPAPPVSAPAALPSSTAAENKASPAGTAGGPGAGAAAGGTGPLAARAGEPAERRGAAPVSAGGAAPPEGAISNGVYVLPSAANGDVKPVVSSTPLVDFLMQLEDYTPTIPDAVTGYYLNRAGFEASDPRIIRLISLAAQKFISDIANDALQHCKMKGTASGSSRSKSKDRKYTLRHGGLDPVPLPEIKEQLTEKRDRKRKESGKQNEHTHKKNRTRGGRSERPRERQAATRPKKSEAEQTERSGAKKSEGQREAGERRGKEGKRRGRRSGDGRKAGENEGQRGERATDKRRA

SEQ ID NO: 855531 - protein, 218 aa, Homo sapiens; identical to SEQ ID NO: 855529

SEQ ID NO: 855532 - protein, 138 aa, Homo sapiens
MSCSGSGADPEAAPASAASAPGPAPPVSAPAALPSSTAAENKASPAGTAGGPGAGAAAGGTGPLAARAGEPAERRGAAPVSAGGAAPPEGAISNGVYVLPSAANGDVKPVVSSTPLVDFLMQLEDYTPTVGFRPNKAT

SEQ ID NO: 855533 - protein, 40 aa, Homo sapiens
MQLEDYTPTIPDAVTGYYLNRAGFEASDPRIFGSSPSQIP

SEQ ID NO: 855534 - protein, 138 aa, Homo sapiens; identical to SEQ ID NO: 855532

SEQ ID NO: 855535 - protein, 113 aa, Homo sapiens
GNQRQKTTVVSLSLAWHITRDTERDAVTEYTRAQKSDSVGHSMHAGIRLISLAAQKFISDIANDALQHCKMKGTASGSSRSKSKDRKYTLTMEDLTPALSEYGINVKKPHYFT

SEQ ID NO: 855536 - protein, 268 aa, Homo sapiens
MAGAEGAAGRQSELEPVVSLVDVLEEDEELENEACAVLGGSDSEKCSYSQNIYRFVIRGKQQRFNKFGTCTLLPDKAKVNSGNKYNDNFFGLYCICKRPYPDPEDEIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQTFSYSPGRYTTCYASSGAKGGSVFLYKLLSFKLLKSTEL

SEQ ID NO: 855537 - protein, 280 aa, Homo sapiens
MAGAEGAAGRQSELEPVVSLVDVLEEDEELENEACAVLGGSDSEKCSYSQGSVKRQALYACSTCTPEGEEPAGICLACSYECHGSHKLFELYTKRNFRCDCGNSKFKNLECKLLPDKAKVNSGNKYNDNFFGLYCICKRPYPDPEDEIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQVMCEVRAIKK

SEQ ID NO: 855538 - protein, 69 aa, Homo sapiens
HRRPAPNPRPHLDAATTSRLLRERTFSSSLKSFSQKREEEWMGCSITAARVEYEAFSFKPMKMRFPFLE

SEQ ID NO: 855539 - protein, 309 aa, Homo sapiens
MAGAEGAAGRQSELEPVVSLVDVLEEDEELENEACAVLGGSDSEKCSYSQGSVKRQALYACSTCTPEGEEPAGICLACSYECHGSHKLFELYTKRNFRCDCGNSKFKNLECKLLPDKAKVNSGNKYNDNFFGLYCICKRPYPDPEDEIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQTFSYSPGRYTTCYASSGAKGGSVFLYKLLSFKLLKSTEL

SEQ ID NO: 855540 - protein, 425 aa, Homo sapiens
MAGAEGAAGRQSELEPVVSLVDVLEEDEELENEACAVLGGSDSEKCSYSQGSVKRQALYACSTCTPEGEEPAGICLACSYECHGSHKLFELYTKRNFRCDCGNSKFKNLECKLLPDKAKVNSGNKYNDNFFGLYCICKRPYPDPEDEIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQTVFKNESLNAESKSGCKLQELKAKQLIKKDTATYWPLNWRSKLCTCQDCMKMYGDLDVLFLTDEYDTVLAYENKGKIAQATDRSDPLMDTLSSMNRVQQVELICEYNDLKTELKDYLKRFADEGTVVKREDIQQFFEEFQSKKRRRVDGMQYYCS

SEQ ID NO: 855541 - protein, 416 aa, Homo sapiens
MAGAEGAAGRQSELEPVVSLVDVLEEDEELENEACAVLGGSDSEKCSYSQGSVKRQALYACSTCTPEGEEPAGICLACSYECHGSHKLFELYTKSKFKNLECKLLPDKAKVNSGNKYNDNFFGLYCICKRPYPDPEDEIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQTVFKNESLNAESKSGCKLQELKAKQLIKKDTATYWPLNWRSKLCTCQDCMKMYGDLDVLFLTDEYDTVLAYENKGKIAQATDRSDPLMDTLSSMNRVQQVELICEYNDLKTELKDYLKRFADEGTVVKREDIQQFFEEFQSKKRRRVDGMQYYCS

SEQ ID NO: 855542 - protein, 425 aa, Homo sapiens; identical to SEQ ID NO: 855540

SEQ ID NO: 855543 - protein, 425 aa, Homo sapiens; identical to SEQ ID NO: 855540

SEQ ID NO: 855544 - protein, 118 aa, Homo sapiens
WTAGFPSTCQEGGTRVNHGLLRRPAKRCTAGCRQPHFGQVPPHELGRLSHGEGGEGKPPRASEPGRCCTGLAVACGADVRARSQQMAAGPATAAADVFESVVRCSWGFTRPNFPSPRH

SEQ ID NO: 855545 - protein, 459 aa, Homo sapiens
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 855546 - protein, 334 aa, Homo sapiens
MPSKESWSGRKTNRAAVHKSKQEGRQQDLLIAALGMKLGSPKSSVTIWQPLKLFAYSQLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 855547 - protein, 459 aa, Homo sapiens; identical to SEQ ID NO: 855545

SEQ ID NO: 855548 - protein, 288 aa, Homo sapiens
MPSKESWSGRKTNRAAVHKSKQEGRQQDLLIAALGMKLGSPKSSVTIWQPLKLFAYSQLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDREIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 855549 - protein, 299 aa, Homo sapiens
MKLGSPKSSVTIWQPLKLFAYSQLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 855550 - protein, 204 aa, Homo sapiens
MPSKESWSGRKTNRAAVHKSKQEGRQQDLLIAALGMKLGSPKSSVTIWQPLKLFAYSQLTSLVRRATLKENEQIPKYEKIHNFKVHTFRGPHWCEYCANFMWGLIAQGVKCAEIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 855551 - protein, 234 aa, Homo sapiens
MWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 855552 - protein, 324 aa, Homo sapiens
GGVWGSCIMLLILCRIMYLLIAALGMKLGSPKSSVTIWQPLKLFAYSQLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 855553 - protein, 511 aa, Homo sapiens
WETLSQDGVCEAAGCGVSAPRRGLCEAAAALPVAAAAAASAAPPLRQPLRRGQASCLADTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 855554 - protein, 234 aa, Homo sapiens; identical to SEQ ID NO: 855551

SEQ ID NO: 855555 - protein, 91 aa, Homo sapiens
WETLSQDGVCEAAGCGVSAPRRGLCEAAAALPVAAAAAASAAPPLRQPLRRGQASCLAGTSSRAHAPRLMAATSAGSRRASGAPWARCARQ

SEQ ID NO: 855556 - protein, 334 aa, Homo sapiens; identical to SEQ ID NO: 855546

SEQ ID NO: 855557 - protein, 334 aa, Homo sapiens; identical to SEQ ID NO: 855546

SEQ ID NO: 855558 - protein, 459 aa, Homo sapiens; identical to SEQ ID NO: 855545

SEQ ID NO: 855559 - protein, 334 aa, Homo sapiens; identical to SEQ ID NO: 855546

SEQ ID NO: 855560 - protein, 334 aa, Homo sapiens; identical to SEQ ID NO: 855546

SEQ ID NO: 855561 - protein, 279 aa, Homo sapiens
MTFLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 855562 - protein, 277 aa, Homo sapiens
MATMGLLMLLTLAASPHFLSICFHHVCVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 855563 - protein, 482 aa, Homo sapiens
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRVSSNRTGLMTCSTAGNVDSLSQWMTFLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKKYGSDGALNPYEDETMALVMKPRYQDIKNGLQKGILMETGMWTPIIKNWVSIGKHAGPSRTFNGANNSHIMAIKRNKFDKVIRLLPLL

SEQ ID NO: 855564 - protein, 197 aa, Homo sapiens
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRVSSNRTGLMTCSTA

SEQ ID NO: 855565 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 855566 - protein, 826 aa, Homo sapiens; identical to SEQ ID NO: 855565

SEQ ID NO: 855567 - protein, 834 aa, Homo sapiens
SLTVHLSKICARHCILQYWQISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 855568 - protein, 645 aa, Homo sapiens
GSRDSVRWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 855569 - protein, 610 aa, Homo sapiens
MTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 855570 - protein, 386 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTKGT

SEQ ID NO: 855571 - protein, 826 aa, Homo sapiens; identical to SEQ ID NO: 855565

SEQ ID NO: 855572 - protein, 735 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGII

SEQ ID NO: 855573 - protein, 300 aa, Homo sapiens [sequence omitted]

SEQ ID NO: 855574 - protein, 237 aa, Homo sapiens
PTHIHKETTSATSSPYRDTINDANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 855575 - protein, 202 aa, Homo sapiens
SESTRTRLHPAHNTWKLNKAKSIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 855576 - protein, 599 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQFRRLVHRQHFNPSPLPRISNPYTHLP

SEQ ID NO: 855577 - protein, 574 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPAHVAGPS

SEQ ID NO: 855578 - protein, 211 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFEPSWTQCVRFYSLACDIEAMRELALPRRACETGQPHTHQEFPHKEMALNARRTYLSGPGGLAEGHSHMSPRTPAGKPQSGRWTSTT

SEQ ID NO: 855579 - protein, 826 aa, Homo sapiens; identical to SEQ ID NO: 855565

SEQ ID NO: 855580 - protein, 689 aa, Homo sapiens
PIWPGEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 855581 - protein, 785 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 855582 - protein, 417 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNA

SEQ ID NO: 855583 - protein, 427 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNVIWSMNSSWNW

SEQ ID NO: 855584 - protein, 503 aa, Homo sapiens
HQNVRNENDKDVNQQANSAVGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 855585 - protein, 255 aa, Homo sapiens
MTLQIKYDQPVRTSSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 855586 - protein, 723 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNVRALDQVN

SEQ ID NO: 855587 - protein, 712 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQNPGFSPLLGKGGKKR

SEQ ID NO: 855588 - protein, 418 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNGE

SEQ ID NO: 855589 - protein, 352 aa, Homo sapiens
MNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 855590 - protein, 1170 aa, Homo sapiens
MCSWCPPQATSSSGCYLSRGLSFPFPQLYPSARPPSNLFISKFCLTFPRGEGCFLVCPYSSFPFLSCILVQPGNVGLFMVVCHDSLTIMPPCIPCSSWNLAPCLTWKSCHCQPGESPEGGVTGAGPEAKRWEEVGGQGLSRTRRLETGKDKAGGGLSCLGHLCRPERPGNIHTAEGGLGGLGPELGEEMRTEAGPGFSRVLLFPSTTRESYCPTSACAVSWQGRLSHAWTPGCVGDGKEQGEGGAPGEAQDEPHLVPPHSCLTLCKCDRHRTGVGTSPTAAYPFSFSRPPILLAPSLVSRSVHVPLHPTIQFCPDVLEWGWTRRRGQTRGVVVEIVTAWGEDFYACLPLSSGKEARSGAGQLTGSRGSGFQEGVVFEVGSGSSWKSGLPGRKEAGCREVRRRHGTFSSGITGGVCPTPERPLWRLPPTCRPRRMSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPDGTFDSRPYNLLPFPGPFPPPTHPPEVLPTAMNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 855591 - protein, 982 aa, Homo sapiens
MRTEAGPGFSRVLLFPSTTRESYCPTSACAVSWQGRLSHAWTPGCVGDGKEQGEGGAPGEAQDEPHLVPPHSCLTLCKCDRHRTGVGTSPTAAEPFSFSRPPILLAPSLVSRSVHVPLHPTIQFCPDVLEWGWTRRRGQTRGVVVEIVTAWGEDFYACLPLSSGKEARSGAGQLTGSRGSGFQEGVVFEVGSGSSWKSGLPGRKEAGCREVRRRHGTFSSGITGGVCPTPERPLWRLPPTCRPRRMSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPDGTFDSRPYNLLPFPVPFHPPPTLQKVLPTAMNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 855592 - protein, 737 aa, Homo sapiens
MSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPDGTFDSRPYNLLPFPGPFPPPTHPPEVLPTAMNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 855593 - protein, 90 aa, Homo sapiens
SIQGQYVALACSRHGSRVLDAIWSGAALRARKEIAAELGEQNQELIRDPFGHHVARNVALTTFLKRREAWEQQQGAVAKRRRALNSILED

SEQ ID NO: 855594 - protein, 737 aa, Homo sapiens; identical to SEQ ID NO: 855592

SEQ ID NO: 855595 - protein, 377 aa, Homo sapiens
MASGNPWSSTLMRVSALTLQVLPTAMNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 855596 - protein, 252 aa, Homo sapiens [sequence omitted]

SEQ ID NO: 855597 - protein, 1013 aa, Homo sapiens
MFGSPLQARETRQHTHCRRWAGRIGARAGGGMRTEAGPGFSRVLLFPSTTRESYCPTSACAVSWQGRLSHAWTPGCVGDGKEQGEGGAPGEAQDEPHLVPPHSCLTLCKCDRHRTGVGTSPTAAYPFSFSRPPILLAPSLVSRSVHVPLHPTIQFCPDVLEWGWTRRRGQTRGVVVEIVTAWGEDFYACLPLSSGKEARSGAGQLTGSRGSGFQEGVVFEVGSGSSWKSGLPGRKEAGCREVRRRHGTFSSGITGGVCPTPERPLWRLPPTCRPRRMSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPDGTFDSRPYNLLPFPGPFPPPTHPPEVLPTAMNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 855598 - protein, 90 aa, Homo sapiens; identical to SEQ ID NO: 855593

SEQ ID NO: 855599 - protein, 90 aa, Homo sapiens; identical to SEQ ID NO: 855593

SEQ ID NO: 855600 - protein, 155 aa, Homo sapiens
MDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGEAAQSWCSTRAGNAVWVLIVRYTD

SEQ ID NO: 855601 - protein, 197 aa, Homo sapiens
SGVPPFGAGLRPTQPSRPPTLQPAGSTDPRKGKGAASGRRDSCRRAPSRPKPPSPAPAMARGGSQSWSSGESDGQPKEQTPEKPRHKMVKETQYYDILGVKPSASPEEIKKAYRKLALKYHPDKNPDEGEKGHGHLQPDISLYSYSGFSVTSDTQLIISTNHRLKMLCILETEVKSFSILFTESLLFISKEAHDPPE

SEQ ID NO: 855602 - protein, 727 aa, Homo sapiens
SGVPPFGAGLRPTQPSRPPTLQPAGSTDPRKGKGAASGRRDSCRRAPSRPKPPSPAPAMARGGSQSWSSGESDGQPKEQTPEKPRHKMVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKDRSCTSMGNKHTHFHGSTGTIQRSLEHGSRGCMSIHLSLASRQASHSSTYPAARRPIDLDSMHTLHHIQAYLQAPSDRLHSKHDNKNDLGAIALRRFLSIQKQRDGRYTATEDLTHACDDDTECPYYQRTPGNKAGLPCTPEQDITRGYTLIHHEKNNMRLSIMEKQQFTQDMSTTLYITSLRPDTVKGYNTEVTQLDTHSKDDASNEKHYRHTKMKPANMSGSKRRRNRPKEETRDPKNRDTPKARGAAQRTAQDLHVRNARDHREGHTHTEKQRSNEKKKNTDEATHAQNETTTITKTTDSIKGNRPKADKTINDTENYEHRTTTYAVKAAARIKKTVNSNLQTNMHHIQQPELVYNVKYNGLRDLRTRKHCSTSTQRRHTSDRTCGTTRRDTRSPERKTQRQRDDRAIDTNHEQHRRRHSEN

SEQ ID NO: 855603 - protein, 327 aa, Homo sapiens
SGVPPFGAGLRPTQPSRPPTLQPAGSTDPRKGKGAASGRRDSCRRAPSRPKPPSPAPAMARGGSQSWSSGESDGQPKEQTPEKPRHKMVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGEAAQSWCSTRAGNAVWVLIVRYTD

SEQ ID NO: 855604 - protein, 431 aa, Homo sapiens
SGVPPFGAGLRPTQPSRPPTLQPAGSTDPRKGKGAASGRRDSCRRAPSRPKPPSPAPAMARGGSQSWSSGESDGQPKEQTPEKPRHKMVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEEHCTWITMHLIRS

SEQ ID NO: 855605 - protein, 484 aa, Homo sapiens
SGVPPFGAGLRPTQPSRPPTLQPAGSTDPRKGKGAASGRRDSCRRAPSRPKPPSPAPAMARGGSQSWSSGESDGQPKEQTPEKPRHKMVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 855606 - protein, 457 aa, Homo sapiens
KSVRRGAGGGRELQAAAAAATVTVTRERAAGARARGAGQGAGRGVRGALTGLARPPRRHKMVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 855607 - protein, 391 aa, Homo sapiens
QSPLRRACRLLISHFSKLAKDMWESLTLDSGQISALTRFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 855608 - protein, 312 aa, Homo sapiens
MDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 855609 - protein, 492 aa, Homo sapiens
SGVPPFGAGLRPTQPSRPPTLQPAGSTDPRKGKGAASGRRDSCRRAPSRPKPPSPAPAMARGGSQSWSSGESDGQPKEQTPEKPRHKMVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQVPAKHCQLVRHNLLKV

SEQ ID NO: 855610 - protein, 426 aa, Homo sapiens
HAAGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 855611 - protein, 426 aa, Homo sapiens; identical to SEQ ID NO: 855610

SEQ ID NO: 855612 - protein, 111 aa, Homo sapiens
HAAGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMHYSDVTID

SEQ ID NO: 855613 - protein, 411 aa, Homo sapiens
MNCCIGLGEKARGSHRASYPSLSALFTEASILGFGSFAVKAQWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 855614 - protein, 267 aa, Homo sapiens
HAAGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGK

SEQ ID NO: 855615 - protein, 330 aa, Homo sapiens [sequence omitted]

SEQ ID NO: 855616 - protein, 426 aa, Homo sapiens; identical to SEQ ID NO: 855610

SEQ ID NO: 855617 - protein, 393 aa, Homo sapiens
MNCCIGLGEKARGSHRASYPSLSALFTEASILGFGSFAVKAQWTEDCRKSTYPPSGPTYRGAVPWYTINLDLPPYKRWHELMLDKAPMLKVIVNSLKNMINTFVPSGKVMQVVDEKLPLFTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 855618 - protein, 392 aa, Homo sapiens
MNCCIGLGEKARGSHRASYPSLSALFTEASILGFGSFAVKAQWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 855619 - protein, 192 aa, Homo sapiens
SRGPSVMYTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 855620 - protein, 296 aa, Homo sapiens
MNCCIGLGEKARGSHRASYPSLSALFTEASILGFGSFAVKAQWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTRYWPQPTLSWEATSLGKVV

SEQ ID NO: 855621 - protein, 426 aa, Homo sapiens; identical to SEQ ID NO: 855610

SEQ ID NO: 855622 - protein, 267 aa, Homo sapiens; identical to SEQ ID NO: 855614

SEQ ID NO: 855623 - protein, 267 aa, Homo sapiens; identical to SEQ ID NO: 855614

SEQ ID NO: 855624 - protein, 181 aa, Homo sapiens
MNCCIGLGEKARGSHRASYPSLSALFTEASILGFGSFAVKAQWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGKVHLEALKKKVIKFFYKFPLRCDIHTAKCTGLRYTAQ

SEQ ID NO: 855625 - protein, 386 aa, Homo sapiens
MNCCIGLGEKARGSHRASYPSLSALFTEASILGFGSFAVKAQWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQELTRPQPKKIFYLKPFFNCPGKQK

SEQ ID NO: 855626 - protein, 201 aa, Homo sapiens
HAAGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGKVHLEALKKKVIKFFYKFPLRCDIHQHKVLYVLDIQHRCCMS

SEQ ID NO: 855627 - protein, 152 aa, Homo sapiens
MNCCIGLGEKARGSHRASYPSLSALFTEASILGFGSFAVKAQWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLERLFTQISY

SEQ ID NO: 855628 - protein, 196 aa, Homo sapiens
HAAGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGKVHLEALKKKVIKFFYKFPLRCDIHTAKCTGLRYTAQ

SEQ ID NO: 855629 - protein, 411 aa, Homo sapiens; identical to SEQ ID NO: 855613

SEQ ID NO: 855630 - protein, 426 aa, Homo sapiens; identical to SEQ ID NO: 855610

SEQ ID NO: 855631 - protein, 427 aa, Homo sapiens
CEFIILLREFIILLREIIILLREFIILLREFIILLREFIILLRDSSPAQLAIAQHAPAWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 855632 - protein, 386 aa, Homo sapiens
PPPPPATPPPPPPPPPAPPPPPPPPPPPPPPPPPRPPPPSPPPPPPPPPPPPPPLPPLPPPPVLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 855633 - protein, 426 aa, Homo sapiens; identical to SEQ ID NO: 855610

SEQ ID NO: 855634 - protein, 411 aa, Homo sapiens
HAAGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKVNSKLTCGTALTLV

SEQ ID NO: 855635 - protein, 408 aa, Homo sapiens
HAAGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKTSGLQNAASET

SEQ ID NO: 855636 - protein, 426 aa, Homo sapiens; identical to SEQ ID NO: 855610

SEQ ID NO: 855637 - protein, 460 aa, Homo sapiens
HAAGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTRIHKLCIDGHPKGPNSENFTWRDLALDALVIRVGKKHNSTGHTSNGRASWRPLNRQTLSNC

SEQ ID NO: 855638 - protein, 306 aa, Homo sapiens
HAAGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTRGKVFRCFTIKYLF

SEQ ID NO: 855639 - protein, 196 aa, Homo sapiens; identical to SEQ ID NO: 855628

SEQ ID NO: 855640 - protein, 196 aa, Homo sapiens; identical to SEQ ID NO: 855628

SEQ ID NO: 855641 - protein, 184 aa, Homo sapiens
HAAGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKG

SEQ ID NO: 855642 - protein, 359 aa, Homo sapiens
MSYRRELEKYRDLDEDEILGALTEEELRTLENELDELDPDNALLPAGLRQKDQTTKAPTGPFKREELLDHLEKQAKEFKDREDLVPYTGEKRGKVWVPKQKPLDPVLESVTLEPELEEALANASDAELCDIAAILGMHTLMSNQQYYQALSSSSIMNKEGLNSVIKPTQYKPVPDEEPNSTDVEETLERIKNNDPKLEEVNLNNIRNIPIPTLKAYAEALKENSYVKKFSIVGTRSNDPVAYALAEMLKENKVLKTLNVESNFISGAGILRLVEALPYNTSLVEMKIDNQSQPLGNKVEMEIVSMLEKNATLLKFGYHFTQQGPRLRASNAMMNNNDLVRKRRLADLTGPIIPKCRSGV

SEQ ID NO: 855643 - protein, 164 aa, Homo sapiens
MDLVLEEDVTVAGTLSGCSGLVPSVPENSYVKKFSIVGTRSNDPVAYALAEMLKENKVLKTLNVESNFISGAGILRLVEALPYNTSLVEMKIDNQSQPLGNKVEMEIVSMLEKNATLLKFGYHFTQQGPRLRASNAMMNNNDLVRKRRLADLTGPIIPKCRSGV

SEQ ID NO: 855644 - protein, 359 aa, Homo sapiens; identical to SEQ ID NO: 855642

SEQ ID NO: 855645 - protein, 359 aa, Homo sapiens; identical to SEQ ID NO: 855642

SEQ ID NO: 855646 - protein, 359 aa, Homo sapiens; identical to SEQ ID NO: 855642

SEQ ID NO: 855647 - protein, 1041 aa, Homo sapiens
MATPAGLERWVQDELHSVLGLSERHVAQFLIGTAQRCTSAEEFVQRLRDTDTLDLSGPARDFALRLWNKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQLVLEEEETIEFVRATQLQGDEEPSAPPTSTQAQQKESIQAVRRSLPVFPFREELLAAIANHQVLIIEGETGSGKTTQIPQYLFEEGYTNKGMKIACTQPRRVAAMSVAARVAREMGVKLGNEVGYSIRFEDCTSERTVLRYMTDGMLLREFLSEPDLASYSVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 855648 - protein, 1041 aa, Homo sapiens; identical to SEQ ID NO: 855647

SEQ ID NO: 855649 - protein, 1041 aa, Homo sapiens; identical to SEQ ID NO: 855647

SEQ ID NO: 855650 - protein, 820 aa, Homo sapiens
MVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQLVLEEEETIEFVRATQLQGDEEPSAPPTSTQAQQKESIQAVRRSLPVFPFREELLAAIANHQVLIIEGETGSGKTTQIPQYLFEEGYTNKGMKIACTQPRRVAAMSVAARVAREMGVKLGNEVGYSIRFEDCTSERTVLRYMTDGMLLREFLSEPDLASYSVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 855651 - protein, 224 aa, Homo sapiens
MATPAGLERWVQDELHSVLGLSERHVAQFLIGTAQRCTSAEEFVQRLRDTDTLDLSGPARDFALRLWNKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMTI

SEQ ID NO: 855652 - protein, 560 aa, Homo sapiens
MESQPAQECLMQMFLPIEPACFVEWLGTSPSQLGVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 855653 - protein, 1041 aa, Homo sapiens; identical to SEQ ID NO: 855647

SEQ ID NO: 855654 - protein, 571 aa, Homo sapiens
MATPAGLERWVQDELHSVLGLSERHVAQFLIGTAQRCTSAEEFVQRLRDTDTLDLSGPARDFALRLWNKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQLVLEEEETIEFVRATQLQGDEEPSAPPTSTQAQQKESIQAVRRSLPVFPFREELLAAIANHQVLIIEGETGSGKTTQIPQYLFEEGYTNKGMKIACTQPRRVAAMSVAARVAREMGVKLGNEVGYSIRFEDCTSERTVLRYMTDGMLLREFLSEPDLASYSVVMVDEAHERTLHTDILFGLIKDVARFRPELKGFVKPPGRAAANLVVVVVVIIRRP

SEQ ID NO: 855655 - protein, 105 aa, Homo sapiens [sequence omitted]

SEQ ID NO: 855656 - protein, 392 aa, Homo sapiens
RGGRTLARVGKSSGGRWRSLPASNRAEPLPWRFSVLRIMSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVPQLPGFSWIKPCISSASIVYIGLRDVDPPEHFILKNYDIQYFSMRDIDRLGIQKVMERTFDLLIGKRQRPIHLSFDIDAFDPTLAPATGTPVVGGLTYREGMYIAEEIHNTGLLSALDLVEVNPQLATSEEEAKTTANLAVDVIASSFGQTREGGHIVYDQLPTPSSPDESENQARVRI

SEQ ID NO: 855657 - protein, 392 aa, Homo sapiens; identical to SEQ ID NO: 855656

SEQ ID NO: 855658 - protein, 244 aa, Homo sapiens
RGGRTLARVGKSSGGRWRSLPASNRAEPLPWRFSVLRIMSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVPQLPGFSWIKPCISSASIVYIGLRDVDPPEQ

SEQ ID NO: 855659 - protein, 383 aa, Homo sapiens
RGGRTLARVGKSSGGRWRSLPASNRAEPLPWRFSVLRIMSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVPQLPGFSWIKPCISSASIVYIGLRDVDPPEHFILKNYDIQYFSMRDIDRLGIQKVMERTFDLLIGKRQRPIHLSFDIDAFDPTLAPATGTPVVGGLTYREGMYIAEEIHNTGLLSALDLVEVNPQLATSEEEAKTTANLAVDVIASSFGQTGRDLVLTTSTPVTDDQISL

SEQ ID NO: 855660 - protein, 136 aa, Homo sapiens
MRDIDRLGIQKVMERTFDLLIGKRQRPIHLSFDIDAFDPTLAPATGTPVVGGLTYREGMYIAEEIHNTGLLSALDLVEVNPQLATSEEEAKTTANLAVDVIASSFGQTREGGHIVYDQLPTPSSPDESENQARVRI

SEQ ID NO: 855661 - protein, 221 aa, Homo sapiens
RGGRTLARVGKSSGGRWRSLPASNRAEPLPWRFSVLRIMSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVSGPKRKER

SEQ ID NO: 855662 - protein, 76 aa, Homo sapiens
RVGAALTEEQAADVVSLRHPGWSAVAQSRLTATSASQVQVILLLQPPRFKRFSCLSLPSSWDYRRSPPCPANFLYF

SEQ ID NO: 855663 - protein, 244 aa, Homo sapiens; identical to SEQ ID NO: 855658

SEQ ID NO: 855664 - protein, 244 aa, Homo sapiens; identical to SEQ ID NO: 855658

SEQ ID NO: 855665 - protein, 300 aa, Homo sapiens
RGGRTLARVGKSSGGRWRSLPASNRAEPLPWRFSVLRIMSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVPQLPGFSWIKPCISSASIVYIGLRDVDPPEHFFVRHLIPDFPENCRLGPEGWTHCRCGHTIPCLLLLTYGPGTCGDPDGIGTTGPTY

SEQ ID NO: 855666 - protein, 89 aa, Homo sapiens
APTFPEDPDSASRPRRACSGLSACRVAFFSSSGAVMAAAKTLNPKAKVAGAQAALAFNISGARGLQDVLRTNLGPKGTIKIKFNTQQLP

SEQ ID NO: 855667 - protein, 86 aa, Homo sapiens
APTFPEDPDSASRPRRACSGLSACRVAFFSSSGAVMAAAKTLNPKAKVAGAQAALAFNISGARGLQDVLRTNLGPKGTIKMAFIPE

SEQ ID NO: 855668 - protein, 89 aa, Homo sapiens; identical to SEQ ID NO: 855666

SEQ ID NO: 855669 - protein, 89 aa, Homo sapiens; identical to SEQ ID NO: 855666

SEQ ID NO: 855670 - protein, 86 aa, Homo sapiens; identical to SEQ ID NO: 855667

SEQ ID NO: 855671 - protein, 105 aa, Homo sapiens
APTFPEDPDSASRPRRACSGLSACRVAFFSSSGAVMAAAKTLNPKAKVAGAQAALAFNISGARGLQDVLRTNLGPKGTIKILVSGAGDIKLTKDTGVDDQPWPTW

SEQ ID NO: 855672 - protein, 390 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 855673 - protein, 659 aa, Homo sapiens
SRSPPPPPFAPWAISLPPPSAEQPDSEGPGRGQGGRPVRGTPPALSRPRGRPRPGAEEGVAEEDELVGRRGKKLLRLFRCRWEPEARGPLGATLPREEAGLGDPRPPPFAAGDACSLPAPYTASLRRPHSGPALGSRRPGLPQRLFPRPRAHPLHAAFIPGLSPEPPRILDPFSSRRRISLRPATDPLFKTTHLLVPDRAHLGYFRGILRHPRSKPPLHHCALLPEDLSFPSRPSYLLPGDPQPLQGRGLPTTPALFALSAVPGGAASPMPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 855674 - protein, 436 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGEACFPGHAQFDVCACVCSHLPHAPLIYPSESVCVCPLSPDSHTKAGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 855675 - protein, 278 aa, Homo sapiens
MVETHYEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 855676 - protein, 332 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKEPPRVGSLQTGIKIPGQEALTQHPYKGV

SEQ ID NO: 855677 - protein, 304 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRRRAACRRRWSRCPSCTTWAASPRWSSCPT

SEQ ID NO: 855678 - protein, 316 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINAPRRRTAACGSCTLTSARTSAGSGSTSPRATMPTSASGPAPTFGAWTRSTARYVWPTGLRDALGGSQDGGRGERKRSKV

SEQ ID NO: 855679 - protein, 191 aa, Homo sapiens
SRSPPPPPFAPWAISLPPPSAEQPDSEGPGRGQGGRPVRGTPPALSRPRGRPRPGAEEGVAEEQPEAPESETSRRRPRHCGEEGEEEREEGRAGREKRKKTFETFPLPLGAGGAGTSWRDAAPRGGRTWGPQTASLCRRGRLLPPCPLHGVPQAPPFRTSPRESPTRPPAKTFPQTSGAPPARRLHPRPVS

SEQ ID NO: 855680 - protein, 390 aa, Homo sapiens; identical to SEQ ID NO: 855672

SEQ ID NO: 855681 - protein, 390 aa, Homo sapiens; identical to SEQ ID NO: 855672

SEQ ID NO: 855682 - protein, 357 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKLNEQNLIQEVPNIWQREVG

SEQ ID NO: 855683 - protein, 332 aa, Homo sapiens [sequence omitted]

SEQ ID NO: 855684 - protein, 248 aa, Homo sapiens [sequence omitted]

SEQ ID NO: 855685 - protein, 246 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGKLRAFARADIAHVPAGSSHCQCVECSSAPKHCLA

SEQ ID NO: 855686 - protein, 234 aa, Homo sapiens
MSSEVSARRDAKKLVRSPSGLRMVPEHRAFGSPFGLEEPQWVPDKECRRCMQCDAKFDFLTRKHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGGGNARATGMFLQYTVPGTEGVTQLKLTVVEDVTVGRRQAVAWLVAMHKAAKLLYESRDQ

SEQ ID NO: 855687 - protein, 296 aa, Homo sapiens
MSSEVSARRDAKKLVRSPSGLRMVPEHRAFGSPFGLEEPQWVPDKECRRCMQCDAKFDFLTRKVRRIPAAWWGAQGWRQEVRVCSGRHRGLAFRRGPGSARPAGATPGAACSLPLLTANPPASAQHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGGGNARATGMFLQYTVPGTEGVTQLKLTVVEDVTVGRRQAVAWLVAMHKAAKLLYESRDQ

SEQ ID NO: 855688 - protein, 234 aa, Homo sapiens; identical to SEQ ID NO: 855686

SEQ ID NO: 855689 - protein, 252 aa, Homo sapiens
MSSEVSARRDAKKLVRSPSGLRMVPEHRAFGSPFGLEEPQWVPDKECRRCMQCDAKFDFLTRKHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGEKDIHAYTSLRGSQPASEGGNARATGMFLQYTVPGTEGVTQLKLTVVEDVTVGRRQAVAWLVAMHKAAKLLYESRDQ

SEQ ID NO: 855690 - protein, 189 aa, Homo sapiens
RGPGRGGRCPGLGEGPGAGPLAERLRRRHVLRGVRAPRRQEAGALPERPAHGARTPRLRKPVRPGGAAVGPGQGGATFLVTFGNSEKPETMTCRLSNNQRYLFLDGDSHYEIEIVHISTVQILTEGFPPGGGNARATGMFLQYTVPGTEGVTQLKLTVVEDVTVGRRQAVAWLVAMHKAAKLLYESRDQ

SEQ ID NO: 855691 - protein, 48 aa, Homo sapiens
MVKDTPKDCVHIIINGLFPPCYLLVDVSVTPSWDTGALRRENLLPQAW

SEQ ID NO: 855692 - protein, 103 aa, Homo sapiens
MGSLCCLCGSCWRCVRQALCPTPSPMATTIRYLLWGEGWDGSCARVCEGRLLLLPSLLGDWAGTVCLGPGTTVIHIALLWCLSTYSFSDEAALIPTHDSPAYN

SEQ ID NO: 855693 - protein, 1563 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGEWPLYPSNPVTLHPFALVPLGRHLKCPQSLLSLCYSGLLWDPLVHFPWSLMDPAPFGYPNYAGGAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 855694 - protein, 1657 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLRYVIRLWGGEPLMTKDMVGAGQVGAAVEVYAGWVQVVAVPGIWGRVPRVSWGPFPHLGIACSGASFLQLLQSLGPELAITLLLAVLTEHKLLVHSLRPDLLTSVCEALVSVSAAPPGPSSPEPWFFLVPLSLPGLFPFPSLWRILSPFPWAQPAGTHSFHQELFSRAYFQQPLSTGTNSPRPMPSLSLSCASHCCLNPLFTGSHCLVLQMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 855695 - protein, 985 aa, Homo sapiens
MRAELRVTLWEPALTLRLPWPPAYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 855696 - protein, 1593 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGEWPLYPSNPVTLHPFALVPLGRHLKCPQSLLSLCYSGLLWDPLVHFPWSLMDPAPFGYPNYAGGAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSESGIWPGWGGWVPYPEGSVILVAFFPFIQGQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 855697 - protein, 1563 aa, Homo sapiens; identical to SEQ ID NO: 855693

SEQ ID NO: 855698 - protein, 1377 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGEWPLYPSNPVTLHPFALVPLGRHLKCPQSLLSLCYSGLLWDPLVHFPWSLMDPAPFGYPNYAGGAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYLLA

SEQ ID NO: 855699 - protein, 911 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGEWPLYPSNPVTLHPFALVPLGRHLKCPQSLLSLCYSGLLWDPLVHFPWSLMDPAPFGYPNYAGGAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRHAFLPKCLYFILNYLFWSHSPLAYEVLMESEKGKGNRAPWSGGL

SEQ ID NO: 855700 - protein, 927 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGEWPLYPSNPVTLHPFALVPLGRHLKCPQSLLSLCYSGLLWDPLVHFPWSLMDPAPFGYPNYAGGAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKVPTLG

SEQ ID NO: 855701 - protein, 702 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLRYVIRLWGGEPLMTKDMVGAGQVGAAVEVYAGWVQVVAVPGIWGRVPRVSWGPFPHLGIACSGASFLQLLQSLGPELAITLLLAVLTEHKLLVHSLRPDLLTSVCEALVSVSAAPPGPSSPEPWFFLVPLSLPGLFPFPSLWRILSPFPWAQPAGTHSFHQELFSRAYFQQPLSTGTNSPRPMPSLSLSCASHCCLNPLFTGSHCLVLQMIFPLHWQCPYIPLCPLVLADVLSAPVPFIVGIHSSYFDLHDPPADVICVDLDTNTLFQTEEKKLLSPRTLPRRPYKVLLATLTNLYQQLDQRSSRRIPQ

SEQ ID NO: 855702 - protein, 151 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPALLRKAAVLRTAVEAEVVEGMHPSVHFRTQASLQ

SEQ ID NO: 855703 - protein, 42 aa, Homo sapiens [sequence omitted]

SEQ ID NO: 855704 - protein, 1433 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAVLRGVPKGQAIRATGTGTGPAERRGAGSGTGGQAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 855705 - protein, 1497 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 855706 - protein, 1440 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGVGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 855707 - protein, 1457 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGEWPLYPSNPVTLHPFALVPLGRHLKCPQSLLSLCYSGLLWDPLVHFPWSLMDPAPFGYPNYAGGAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQARSPSGWYGQALYLHPLVWHCWSQCCAMLDSMKCTRLWGSCWKL

SEQ ID NO: 855708 - protein, 1453 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGEWPLYPSNPVTLHPFALVPLGRHLKCPQSLLSLCYSGLLWDPLVHFPWSLMDPAPFGYPNYAGGAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQVSAPMWPLFPKCLPHLSAICPLCPWHCRKSIDWPGTVAHACNPSTLGGRGGRIT

SEQ ID NO: 855709 - protein, 1252 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGEWPLYPSNPVTLHPFALVPLGRHLKCPQSLLSLCYSGLLWDPLVHFPWSLMDPAPFGYPNYAGGAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEVRWFVVPSKSGTGS

SEQ ID NO: 855710 - protein, 706 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLRYVIRLWGGEPLMTKDMVGAGQVGAAVEVYAGWVQVVAVPGIWGRVPRVSWGPFPHLGIACSGASFLQLLQSLGPELAITLLLAVLTEHKLLVHSLRPDLLTSVCEALVSVSAAPPGPSSPEPWFFLVPLSLPGLFPFPSLWRILSPFPWAQPAGTHSFHQELFSRAYFQQPLSTGTNSPRPMPSLSLSCASHCCLNPLFTGSHCLVLQMIFPLHWQCPYIPLCPLVLADVLSAPVPFIVGIHSSYFDLHDPPADVICVDLDTNTLFQTEEKKLLSPRTLPRRPYKVLLATLTNLYQQLDQTMPFYLSVCILF

SEQ ID NO: 855711 - protein, 373 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGEWPLYPSNPVTLHPFALVPLGRHLKCPQSLLSLCYSGLLWDPLVHFPWSLMDPAPFGYPNYAGGAELLGRYPEEDNEAFPLPESVPVFCLPMGATIECWPAQTKYPVPVFSTFVLTGAAGDKVYGAALQFYEAFPRARLSERQARVRWFVVPSKSGTGS

SEQ ID NO: 855712 - protein, 108 aa, Homo sapiens
SPKSAGASGSKDAPVPGGPGPVLSDRRLCLALDEPQLCNGHMGVRAGPKGHEERECCPVWGLWGARERWAHLLPLRARGIPKAVGCGGSVGGKALGMYMPSTALPLCA

SEQ ID NO: 855713 - protein, 167 aa, Homo sapiens
AGEPGRPHSPQPPRPWQEPKPGAAEAQRSAGAEGRGGWERRSPTHRPPPAQRAPRGADLPLLQETQPLVTMTSLLTTPSPREELMTTPILQPTEALSPEDGASTALIAVVITVVFLTLLSVVILIFFYLYKNKGSYVTYEPTEGEPSAIVQMESDLAKGSEKEEYFI

SEQ ID NO: 855714 - protein, 72 aa, Homo sapiens
EDTEDSGGDLPLLQETQPLVTMTSLLTTPSPREELMTTPILQPTEALSPEDGASTALIAVVSPPGFWDPLDH

SEQ ID NO: 855715 - protein, 80 aa, Homo sapiens
PAFAGASRISGARGAGWGPVRLGRLCADRALDGESRPGGGGQSGVPASEASQKAAHGRRLPVPARLLRCAHSALEPGRGS

SEQ ID NO: 855716 - protein, 158 aa, Homo sapiens
ARHPRLPPLGVLARPLLASATPRCPPPLSSKGRAERRRPFTSSPSDWKDLPLLQETQPLVTMTSLLTTPSPREELMTTPILQPTEALSPEDGASTALIAVVITVVFLTLLSVVILIFFYLYKNKGSYVTYEPTEGEPSAIVQMESDLAKGSEKEEYFI

SEQ ID NO: 855717 - protein, 51 aa, Homo sapiens
MTSLLTTPSPREELMTTPILQPTEALSPEDGASTALIAVVITTRILGSSRS

SEQ ID NO: 855718 - protein, 158 aa, Homo sapiens; identical to SEQ ID NO: 855716

SEQ ID NO: 855719 - protein, 80 aa, Homo sapiens; identical to SEQ ID NO: 855715

SEQ ID NO: 855720 - protein, 80 aa, Homo sapiens; identical to SEQ ID NO: 855715

SEQ ID NO: 855721 - protein, 80 aa, Homo sapiens; identical to SEQ ID NO: 855715

SEQ ID NO: 855722 - protein, 73 aa, Homo sapiens
AVVPVVRVRIEGLGGSRGEPALSPAGSTPDQGGLGPGRSLRPPPPTPCLEPPRGSGLFDLEDGAVPKSLRAKA

SEQ ID NO: 855723 - protein, 171 aa, Homo sapiens
ADLTREDLAPSSVDSGQAGFGGCCESGLPNTMPSAFSVSSFPVSIPAVLTQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 855724 - protein, 345 aa, Homo sapiens
QAGTGPRKMGSLGTGRRGRAGSMNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNLNQPIEVTALYSFEGQQPGDLNFQAGDRITVISKTDSHFDWWEGKLRGQTGIFPANYVTMN

SEQ ID NO: 855725 - protein, 370 aa, Homo sapiens
RTNANRAARVRATPAQSAPVRLRRRSYDVNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNRNEYKLYPGLSSYHERVGNLNQPIEVTALYSFEGQQPGDLNFQAGDRITVISKTDSHFDWWEGKLRGQTGIFPANYVTMN

SEQ ID NO: 855726 - protein, 121 aa, Homo sapiens
GGEGAAGVNNPIPSNLKSEAKKAAKILREFTEITSRNGPDKIIPAHVIAKAKGLAILSVIKAGFLVTARGGSGIVVARLPDGKWSAPSAIGIAGLGGGFEIGIETHLQLHIPSEHCPGCLP

SEQ ID NO: 855727 - protein, 280 aa, Homo sapiens
MNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRFYCQDIRAYDILFGDTPRPAQAEDLYEILDSFTEKYENEGQRINARKAAREQRKSSAKELPPKPLSRPQQSSAPVQLNSGSQSNLNQPIEVTALYSFEGQQPGDLNFQAGDRITVISKTDSHFDWWEGKLRGQTGIFPANYVTMN

SEQ ID NO: 855728 - protein, 215 aa, Homo sapiens
QAGTGPRKMGSLGTGRRGRAGSMNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRNLEGNVALRSSAAVFTYCKSRGLFAGVSLEGSCLIERKETNRKSVQVKVILIESVMRK

SEQ ID NO: 855729 - protein, 127 aa, Homo sapiens
MLSGYLQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 855730 - protein, 230 aa, Homo sapiens
QAGTGPRKMGSLGTGRRGRAGSMNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRFYCQDIRAYDILFGDTPRPAQAEDLYEILDSFTEKYENEGQRINARKAAREQRKSSVPFGFMFHSVFSENLFL

SEQ ID NO: 855731 - protein, 226 aa, Homo sapiens
MNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRFYCQDIRAYDILFGDTPRPAQAEDLYEILDSFTEKYENEGQRINARKAAREQRKSSAKELPPKPLSRPQQSSAPVQLNSGSQSKYFCCNSN

SEQ ID NO: 855732 - protein, 164 aa, Homo sapiens
VPGSSDRSQGSPRPTWPPRGDMGTRWGLGRKPCSPHLRASGLLQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 855733 - protein, 246 aa, Homo sapiens
MVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNRNEYKLYPGLSSYHERVGNLNQPIEVTALYSFEGQQPGDLNFQAGDRITVISKTDSHFDWWEGKLRGQTGIFPANYVTMN

SEQ ID NO: 855734 - protein, 114 aa, Homo sapiens
MNNPIPSNLKSEAKKAAKILREFTEITSRNGPDKIIPAHVIAKAKGLAILSVIKAGFLVTARGGSGIVVARLPDGKWSAPSAIGIAGLGGGFEIGIETHLQLHIPSEHCPGCLP

SEQ ID NO: 855735 - protein, 364 aa, Homo sapiens
QAGTGPRKMGSLGTGRRGRAGSMNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNRNEYKLYPGLSSYHERVGNLNQPIEVTALYSFEGQQPGDLNFQAGDRITVISKTDSHFDWWEGKLRGQTGIFPANYVTMN

SEQ ID NO: 855736 - protein, 349 aa, Homo sapiens
GGEGAAGVNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNRNEYKLYPGLSSYHERVGNLNQPIEVTALYSFEGQQPGDLNFQAGDRITVISKTDSHFDWWEGKLRGQTGIFPANYVTMN

SEQ ID NO: 855737 - protein, 273 aa, Homo sapiens
QAGTGPRKMGSLGTGRRGRAGSMNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSVPFGFMFHSVFSENLFL

SEQ ID NO: 855738 - protein, 127 aa, Homo sapiens; identical to SEQ ID NO: 855729

SEQ ID NO: 855739 - protein, 144 aa, Homo sapiens
MGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKEDSGAPRGWISGPFPTTQAAPKAWRWGGCAHPPA

SEQ ID NO: 855740 - protein, 122 aa, Homo sapiens
MQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 855741 - protein, 129 aa, Homo sapiens
MKRNTCDLLSRSKSASEETLHSSNEEEDPFRGMEPYLVRRLSCRNIQLPPLAFRQLEQADLKSESENIQRPTSLPLKILPLIAITSAESSGRRHFSEIVLHGRAENVLVNANKHLPKGSCTWKINIGHM

SEQ ID NO: 855742 - protein, 559 aa, Homo sapiens
RSGIMRESALEPGPVPEAPAGGPVHAVTVVTLLEKLASMLETLRERQGGLARRQGGLAGSVRRIQSGLGALSRSHDTTSNTLAQLLAKAERVSSHANAAQERAVRRAAQVQRLEANHGLLVARGKLHVLLFKEEGEVPASAFQKAPEPLGPADQSELGPEQLEAEVGESSDEEPVESRAQRLRRTGLQKDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 855743 - protein, 111 aa, Homo sapiens
AGVRSAGSPQGSHELVSCTELSPHGSQPRCSFALRRTQWCEGSSLYKHLHVQETKFQMFQLIDIARQTAQGMDYLHAKNIIHRDMKSNSILWLLSSFDCSVLNLGKQKGGF

SEQ ID NO: 855744 - protein, 59 aa, Homo sapiens
MEHIQGAWKTISNGFGFKDAVFDGSSCISPTIVQQFGSQLRRTASVYLHEYNMRRYRAD

SEQ ID NO: 855745 - protein, 530 aa, Homo sapiens
MEHIQGAWKTISNGFGFKDAVFDGSSCISPTIVQQFGYQRRASDDGKLTDPSKTSNTIRVFLPNKQRTVVNVRNGMSLHDCLMKALKVRGLQPECCAVFRLLHEHKGKKARLDWNTDAASLIGEELQVDFLDHVPLTTHNFARKTFLKLAFCDICQKFLLNGFRCQTCGYKFHEHCSTKVPTMCVDWSNIRQLLLFPNSTIGDSGVPALPSLTMRRMRESVSRMPVSSQHRYSTPHAFTFNTSSPSSEGSLSQRQRSTSTPNVHMVSTTLPVDSRMIEDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVQVEQPTGSVLWMVRIWAPTSSLWYRAKGMPWRFMCKLKAFLYISPKST

SEQ ID NO: 855746 - protein, 615 aa, Homo sapiens
MEHIQGAWKTISNGFGFKDAVFDGSSCISPTIVQQFGYQRRASDDGKLTDPSKTSNTIRVFLPNKQRTVVNVRNGMSLHDCLMKALKVRGLQPECCAVFRLLHEHKGKKARLDWNTDAASLIGEELQVDFLDHVPLTTHNFARKTFLKLAFCDICQKFLLNGFRCQTCGYKFHEHCSTKVPTMCVDWSNIRQLFSQHRYSTPHAFTFNTSSPSSEGSLSQRQRSTSTPNVHMVSTTLPVDSRMIEDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 855747 - protein, 648 aa, Homo sapiens [sequence omitted]

SEQ ID NO: 855748 - protein, 130 aa, Homo sapiens
MQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 855749 - protein, 648 aa, Homo sapiens [sequence omitted]

SEQ ID NO: 855750 - protein, 648 aa, Homo sapiens [sequence omitted]

SEQ ID NO: 855751 - protein, 648 aa, Homo sapiens [sequence omitted]

SEQ ID NO: 855752 - protein, 107 aa, Homo sapiens [sequence omitted]

SEQ ID NO: 855753 - protein, 112 aa, Homo sapiens
FLLMPLKLIFNNFFSLHSYLHAKNIIHRDMKSNSILWLLSSFDCSVLNLGKQKGGFLSQVALGARGYLFKERGRGQENRKVRKLVGLACPSAAYASPGLMRAMFRLGSFLSL

SEQ ID NO: 855754 - protein, 107 aa, Homo sapiens [sequence omitted]

SEQ ID NO: 855755 - protein, 648 aa, Homo sapiens [sequence omitted]

SEQ ID NO: 855756 - protein, 630 aa, Homo sapiens
MEHIQGAWKTISNGFGFKDAVFDGSSCISPTIVQQFGYQRRASDDGKLTDPSKTSNTIRVFLPNKQRTVVNVRNGMSLHDCLMKALKVRGLQPECCAVFRLLHEHKGKKARLDWNTDAASLIGEELQVDFLDHVPLTTHNFARKTFLKLAFCDICQKFLLNGFRCQTCGYKFHEHCSTKVPTMCVDWSNIRQLLLFPNSTIGDSGVPALPSLTMRRMRESVSRMPVSSQHRYSTPHAFTFNTSSPSSEGSLSQRQRSTSTPNVHMVSTTLPVDSRMIEDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 855757 - protein, 648 aa, Homo sapiens [sequence omitted]

SEQ ID NO: 855758 - protein, 566 aa, Homo sapiens
MANSQILLRQATLSVFSCRTSKEQCKKARLDWNTDAASLIGEELQVDFLDHVPLTTHNFARKTFLKLAFCDICQKFLLNGFRCQTCGYKFHEHCSTKVPTMCVDWSNIRQLLLFPNSTIGDSGVPALPSLTMRRMRESVSRMPVSSQHRYSTPHAFTFNTSSPSSEGSLSQRQRSTSTPNVHMVSTTLPVDSRMIEDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 855759 - protein, 240 aa, Homo sapiens
MGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 855760 - protein, 114 aa, Homo sapiens
FFVSWWFLEGFDDQGRGRRHHLNLGLSVLNGQFHCNPQALPVTPLPNCHHQLFLETDPGASWGPGQKWHRLHLRSPQVYDFDLVGVELRRHGGGGWCRMNPDSGRPKKVLVPNS

SEQ ID NO: 855761 - protein, 648 aa, Homo sapiens [sequence omitted]

SEQ ID NO: 855762 - protein, 530 aa, Homo sapiens; identical to SEQ ID NO: 855745

SEQ ID NO: 855763 - protein, 444 aa, Homo sapiens
MGPLQFRDVAIEFSLEEWHCLDAAQRNLYRDVMLENYRNLIFLGIVVSKPNLITCLEQGKKPLTMKRHEMIAKPPVMYSHFAQDLWSEQSIKDSFQKVILRRYEKCRHDNLQLKKGCESVDECPVHKRGYNGLKQCLATTQRKIFQCDEYVKFLHKFSNSNKHKIRDTGKKSFKCIEYGKTFNQSSTRTTYKKIDAGEKRYKCEECGKAYKQSSHLTTHKKIHTGEKPYKCEECGKAYKQSCNLTTHKIIHTGEKPYRCRECGKAFNHPATLFSHKKIHTGEKPYKCDKCGKAFISSSTLTKHEIIHTGEKPYKCEECGKAFNRSSNLTKHKRIHTGDVPYKCDECGKTFTWYSSLSKHKRAHTGEKPYKCEECGKAFTAFSTLTEHKIIHTGEKPYKCEECGKAFNWSSALNKHKKIHIRQKPCIVKNVENLLNVPQPLISIR

SEQ ID NO: 855764 - protein, 444 aa, Homo sapiens; identical to SEQ ID NO: 855763

SEQ ID NO: 855765 - protein, 444 aa, Homo sapiens; identical to SEQ ID NO: 855763

SEQ ID NO: 855766 - protein, 368 aa, Homo sapiens [sequence omitted]

SEQ ID NO: 855767 - protein, 444 aa, Homo sapiens; identical to SEQ ID NO: 855763

SEQ ID NO: 855768 - protein, 444 aa, Homo sapiens; identical to SEQ ID NO: 855763

SEQ ID NO: 855769 - protein, 444 aa, Homo sapiens; identical to SEQ ID NO: 855763

SEQ ID NO: 855770 - protein, 444 aa, Homo sapiens; identical to SEQ ID NO: 855763

SEQ ID NO: 855771 - protein, 107 aa, Homo sapiens
MGPLQFRDVAIEFSLEEWHCLDAAQRNLYRDVMLENYRNLIFLGIVVSKPNLITCLEQGKKPLTMKRHEMIAKPPDGVSVFHPGWSAVARSRLTATSTSARHGGSCL

SEQ ID NO: 855772 - protein, 111 aa, Homo sapiens
MGPLQFRDVAIEFSLEEWHCLDAAQRNLYRDVMLENYRNLIFLGIVVSKPNLITCLEQGKKPLTMKRHEMIAKPPDGVSVFHPGWSAVARSRLTATSTSQVHTILLPQLPE

SEQ ID NO: 855773 - protein, 136 aa, Homo sapiens
MGPLQFRDVAIEFSLEEWHCLDAAQRNLYRDVMLENYRNLIFLGIVVSKPNLITCLEQGKKPLTMKRHEMIAKPPDGVKFTRLGLPKCWGNRHEPPHPAKFISTSACSRVYCIISIYLKIYQLFILLSYTLIPFLS

SEQ ID NO: 855774 - protein, 444 aa, Homo sapiens; identical to SEQ ID NO: 855763

SEQ ID NO: 855775 - protein, 444 aa, Homo sapiens; identical to SEQ ID NO: 855763

SEQ ID NO: 855776 - protein, 444 aa, Homo sapiens; identical to SEQ ID NO: 855763

SEQ ID NO: 855777 - protein, 695 aa, Homo sapiens
RPRVAAGAAGRMGLSAAAPLWGPPGLLLAIALHPALSVPPRRDYCVLGAGPAGLQMAYFLQRAGRDYAVFERAPRPGSFFTRYPRHRKLISINKRYTGKANAEFNLRHDWNSLLSHDPRLLFRHYSRAYFPDARDMVRYLGDFADTLGLRVQYNTTIAHVTLDKDRQAWNGHYFILTDQKGQVHQCSVLFVATGLSVPNQVDFPGSEYAEGYESVSVDPEDFVGQNVLILGRGNSAFETAENILGVTNFIHMLSRSRVRLSWATHYVGDLRAINNGLLDTYQLKSLDGLLESDLTDLAILKDSKGKFHVTPKFFLEEANTNQSADSITLPQDDNDNFAMRVPYDRVIRCLGWNFDFSIFNKSLRLNSGNAFGKKYPLIRASYESKGSRGLFILGTASHSVDYRKSAGGFIHGFRYTVRAVHRLLEHRHHSVTWPATELPITQLTSSIVRRVNEASGLYQMFGVLADVILLKENSTAFEYLEEFPIQMLAQLETLTGRKAKHGLFVINMEYGRNFSGPDKDVFFDDRSVGHTEDAWQSNFLHPVIYYYRYLPTEQEVRFRPAHWPLPRPTAIHHIVEDFLTDWTAPIGHILPLRRFLENCLDTDLRSFYAESCFLFALTRQKLPPFCQQGYLRMQGLVSTESLWQHRVESRLLRDYAPTGRRLEDSSQQLGDQEPLGSPLAPGPLAQSVDSNKEEL

SEQ ID NO: 855778 - protein, 695 aa, Homo sapiens; identical to SEQ ID NO: 855777

SEQ ID NO: 855779 - protein, 203 aa, Homo sapiens
CSVPFLPLAVPVRAVHRLLEHRHHSVTWPATELPITQLTSSIVRRVNEASGLYQMFGVLADVILLKETGGEVPPCTLAPASAHGHPSHRGRLLNRLDCPDRAHPTSEALPGELFGHRFAKLLCRVLLPVRPHAPEVATLLPAGVPEDAGTREYREPLAAQSGEQAPAGLCPHRQAPGGQQPAAWRPRATRFPPGSRASGSVRR

SEQ ID NO: 855780 - protein, 666 aa, Homo sapiens
RPRVAAGAAGRMGLSAAAPLWGPPGLLLAIALHPALSVPPRRDYCVLGAGPAGLQMAYFLQRAGRDYAVFERAPRPGSFFTRYPRHRKLISINKRYTGKANAEFNLRHDWNSLLSHDPRLLFRHYSRAYFPDARDMVRYLGDFADTLGLRVQYNTTIAHVTLDKDRQAWNGHYFILTDQKGQVHQCSVLFVATGLSVPNQVDFPGSEYAEGYESVSVDPEDFVGQNVLILGRGNSAFETAENILGVTNFIHMLSRSRVRLSWATHYVGDLRAINNGLLDTYQLKSLDGLLESDLTDLAILKDSKGKFHVTPKFFLEEANTNQSADSITLPQDDNDNFAMRVPYDRVIRCLGWNFDFSIFNKSLRLNSGNAFGKKYPLIRASYESKGSRGLFILGTASHSVDYRKSAGGFIHGFRYTVRAVHRLLEHRHHSVTWPATELPITQLTSSIVRRVNEASGLYQMFGVLADVILLKENSTAFEYLEEFPIQMLAQLETLTGRKAKHGLFVINMEYGRNFSGPDKDVFFDDRSVGHTEDAWQSNFLHPVIYYYRYLPTEQEVRFRPAHWPLPRPTAIHHIVEDFLTDWTAPIGHILPLRRFLENCLDTDLRSFYAESCFLFALTRQKLPPFCQQGYLRMQGLMAQRLLLRRFLASVISRKPSQGQWPPLTSR

SEQ ID NO: 855781 - protein, 383 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKAYFKTFVPQFQEAAFANGKL

SEQ ID NO: 855782 - protein, 383 aa, Homo sapiens; identical to SEQ ID NO: 855781

SEQ ID NO: 855783 - protein, 383 aa, Homo sapiens; identical to SEQ ID NO: 855781

SEQ ID NO: 855784 - protein, 383 aa, Homo sapiens; identical to SEQ ID NO: 855781

SEQ ID NO: 855785 - protein, 383 aa, Homo sapiens; identical to SEQ ID NO: 855781

SEQ ID NO: 855786 - protein, 383 aa, Homo sapiens; identical to SEQ ID NO: 855781

SEQ ID NO: 855787 - protein, 383 aa, Homo sapiens; identical to SEQ ID NO: 855781

SEQ ID NO: 855788 - protein, 383 aa, Homo sapiens
MFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKGCQGSRDACSPWEQVLAFAVAKTGCKLLQPQRKLAKLQRASLEGLRGRENCSVILITLGLFQNLCPSVPGGSICQWKALGNTSLERWPARLPVHMRVSTYSRFLEAAWNVFTAAFCSHSSFCTPQAAPTAEIQLELAGGPWILEPFTSGYSLFLASIS

SEQ ID NO: 855789 - protein, 383 aa, Homo sapiens; identical to SEQ ID NO: 855788

SEQ ID NO: 855790 - protein, 177 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWISAISPHTFSRM

SEQ ID NO: 855791 - protein, 318 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKAYFKTFVPQFQEAAFANGKL

SEQ ID NO: 855792 - protein, 342 aa, Homo sapiens
NPEVKLDPGTTSQLKWISAGAWGVQKLLCEQKRCREDIPGGFQEAAVCATHVQQAWLATSQDWCLELTIGKSCLEKSGIAPSGAVRIIFGLGVKLTGKILKCESWLFSREKQRQVNVYKKTTSTTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKAYFKTFVPQFQEAAFANGKL

SEQ ID NO: 855793 - protein, 114 aa, Homo sapiens
ASSGPHTPPARRLKGLFQNLCPSVPGGSICQWKALGNTSLERWPARLPVHMRVSTYSRFLEAAWNVFTAAFCSHSSFCTPQAAPTAEIQLELAGGPWILEPFTSGYSLFLASIS

SEQ ID NO: 855794 - protein, 166 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWG

SEQ ID NO: 855795 - protein, 112 aa, Homo sapiens
RTLRLSNHTEASGLFQNLCPSVPGGSICQWKALGNTSLERWPARLPVHMRVSTYSRFLEAAWNVFTAAFCSHSSFCTPQAAPTAEIQLELAGGPWILEPFTSGYSLFLASIS

SEQ ID NO: 855796 - protein, 521 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKGCQGSRDACSPWEQVLAFAVAKTGCKLLQPQRKLAKLQRASLEGLRGRENCSVILITLGLFQNLCPSVPGGSICQWKALGNTSLERWPARLPVHMRVSTYSRFLEAAWNVFTAAFCSHSSFCTPQAAPTAEIQLELAGGPWILEPFTSGYSLFLASIS

SEQ ID NO: 855797 - protein, 383 aa, Homo sapiens; identical to SEQ ID NO: 855781

SEQ ID NO: 855798 - protein, 521 aa, Homo sapiens; identical to SEQ ID NO: 855796

SEQ ID NO: 855799 - protein, 383 aa, Homo sapiens; identical to SEQ ID NO: 855781

SEQ ID NO: 855800 - protein, 363 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAK

SEQ ID NO: 855801 - protein, 468 aa, Homo sapiens
QKQMLAPCFLYSLQNWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKGCQGSRDACSPWEQVLAFAVAKTGCKLLQPQRKLAKLQRASLEGLRGRENCSVILITLGLFQNLCPSVPGGSICQWKALGNTSLERWPARLPVHMRVSTYSRFLEAAWNVFTAAFCSHSSFCTPQAAPTAEIQLELAGGPWILEPFTSGYSLFLASIS

SEQ ID NO: 855802 - protein, 358 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKAYFKTFVPQFQEAAFANGKL

SEQ ID NO: 855803 - protein, 271 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEQDGISLCVYAQAGLKLLSSHNHQPTPPEVLGIAGPRPHTCPDLAL

SEQ ID NO: 855804 - protein, 166 aa, Homo sapiens; identical to SEQ ID NO: 855794

SEQ ID NO: 855805 - protein, 172 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQMESCSVAQARVEWLNLGSLQAPPPGFTPFSCLSLPSSWDYRRPPPHLASFFIFLVEMGFHHVSQDGLHLLTS

SEQ ID NO: 855806 - protein, 430 aa, Homo sapiens
MVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 855807 - protein, 86 aa, Homo sapiens
QLVPACAVGQRSCIENILRACVGLPPQNHMLLEHKMERPGPSLKRVGPVAATYPMLNKKGPVPAATNGCTGDANGHLQEEPPMPTT

SEQ ID NO: 855808 - protein, 558 aa, Homo sapiens
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 855809 - protein, 504 aa, Homo sapiens
MEAAAQFFVESPDVVYGPEAIEAQYEYRTTRVSREGGVLKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 855810 - protein, 589 aa, Homo sapiens
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGAEPWAGVGRDGRWGLEGPRIRAGPSVRVPPGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 855811 - protein, 541 aa, Homo sapiens
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 855812 - protein, 634 aa, Homo sapiens
MGLPGRCCCPRRGSRWQCGSEEILALEFWSSACFPCSVSDPDPLPTPPEAQLPCPAPPPGLWLGSCVASLSSCKGGKAAMSPWGLRSERGEPIRAALVDAWPLPPGGDPMATVALGCRASNRVSRRWAPPSQRGRGGEGGGAGEGPQRFSPEVARPRARAVRRRCLSRLCAARRDGGRRPVLRREPGRGLRPRGHRGAIRVPDDARQPRGWRSQGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 855813 - protein, 558 aa, Homo sapiens; identical to SEQ ID NO: 855808

SEQ ID NO: 855814 - protein, 452 aa, Homo sapiens
TLRLGTRRVYQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 855815 - protein, 256 aa, Homo sapiens
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGAEPWAGVGRDGRWGLEGPRIRAGPSVRVPPGWDISSLNLAEAMRRAKVLDWGLQEQLWPHMEALRPRPSVYIPEFIAANQSARADNLIPGSRAQQVLSHPASLASCHLFFATWFPLF

SEQ ID NO: 855816 - protein, 205 aa, Homo sapiens
MGLPGRCCCPRRGSRWQCGSEEILALEFWSSACFPCSVSDPDPLPTPPEAQLPCPAPPPGLWLGSCVASLSSCKGGKAAMSPWGLRSERGEPIRAALVDAWPLPPGGDPMATVALGCRASNRVSRRWAPPSQRGRGGEGGGAGEGPQRFSPEVARPRARAVRRRCLSRLCAGECGSGQGRPPWGPRLAWPRPLRVPADPPPTTLP

SEQ ID NO: 855817 - protein, 558 aa, Homo sapiens; identical to SEQ ID NO: 855808

SEQ ID NO: 855818 - protein, 558 aa, Homo sapiens; identical to SEQ ID NO: 855808

SEQ ID NO: 855819 - protein, 767 aa, Homo sapiens
MGLPGRCCCPRRGSRWQCGSEEILALEFWSSACFPCSVSDPDPLPTPPEAQLPCPAPPPGLWLGSCVASLSSCKGGKAAMSPWGLRSERGEPIRAALVDAWPLPPGGDPMATVALGCRASNRVSRRWAPPSQRGRGGEGGGAGEGPQRFSPEVARPRARAVRRRCLSRLCAGECGSGQGRPPWGPRLAWPRPLRVPADPLLTPGPQPAAMEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 855820 - protein, 558 aa, Homo sapiens; identical to SEQ ID NO: 855808

SEQ ID NO: 855821 - protein, 232 aa, Homo sapiens
MSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 855822 - protein, 558 aa, Homo sapiens; identical to SEQ ID NO: 855808

SEQ ID NO: 855823 - protein, 460 aa, Homo sapiens
YKRDPLSVVWAEPWAGVGRDGRWGLEGPRIRAGPSVRVPPGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 855824 - protein, 230 aa, Homo sapiens
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDDILDRLKPWPRRMRAARKVPWDLGGLARKANLVSPAPIGTAPCGPRALTGYTIRPEISIRGPEAEGAAPRNKPSIPVPRRCRRQRGKAGIPE

SEQ ID NO: 855825 - protein, 125 aa, Homo sapiens
RSCIENILRCTPASRFPPGAQIPPWLSYAQGLGGCGGRDTPPFSLWVSGSAKLCDLSRACVGLPPQNHMLLEHKMERPGPSLKRVGPVAATYPMLNKKGPVPAATNGCTGDANGHLQEEPPMPTT

SEQ ID NO: 855826 - protein, 308 aa, Homo sapiens
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 855827 - protein, 367 aa, Homo sapiens
GGEWGGAGGAGRRGRRGLKGRRGEVAFPPRLAIGGAPTSAYSSLPPSCPAPPGDLDQTTMWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 855828 - protein, 367 aa, Homo sapiens; identical to SEQ ID NO: 855827

SEQ ID NO: 855829 - protein, 367 aa, Homo sapiens; identical to SEQ ID NO: 855827

SEQ ID NO: 855830 - protein, 214 aa, Homo sapiens
GGEWGGAGGAGRRGRRGLKGRRGEVAFPPRLAIGGAPTSAYSSLPPSCPAPPGDLDQTTMWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKI

SEQ ID NO: 855831 - protein, 367 aa, Homo sapiens; identical to SEQ ID NO: 855827

SEQ ID NO: 855832 - protein, 367 aa, Homo sapiens; identical to SEQ ID NO: 855827

SEQ ID NO: 855833 - protein, 367 aa, Homo sapiens; identical to SEQ ID NO: 855827

SEQ ID NO: 855834 - protein, 367 aa, Homo sapiens; identical to SEQ ID NO: 855827

SEQ ID NO: 855835 - protein, 249 aa, Homo sapiens
GGEWGGAGGAGRRGRRGLKGRRGEVAFPPRLAIGGAPTSAYSSLPPSCPAPPGDLDQTTMWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPGECLFFLLCASQGGHSFHDRNFVFHNPCQAHKIFYASELCPRTGHSSTQLRKAAKLHLCMCLPIEAAGWVRMLAVFSHFS

SEQ ID NO: 855836 - protein, 84 aa, Homo sapiens
GGEWGGAGGAGRRGRRGLKGRRGEVAFPPRLAIGGAPTSAYSSLPPSCPAPPGDLDQTTMWKRWLALALALVAVAWVRAEAFIK

SEQ ID NO: 855837 - protein, 367 aa, Homo sapiens; identical to SEQ ID NO: 855827

SEQ ID NO: 855838 - protein, 417 aa, Homo sapiens
GGEWGGAGGAGRRGRRGLKGRRGEVAFPPRLAIGGAPTSAYSSLPPSCPAPPGDLDQTTMWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQCLDPSIFSTSALSSVYTSVCYSRQITSICLYSNEFYFVYLFCNKGYEGGWLGREGPQPSFLGVL

SEQ ID NO: 855839 - protein, 367 aa, Homo sapiens; identical to SEQ ID NO: 855827

SEQ ID NO: 855840 - protein, 289 aa, Homo sapiens
GGEWGGAGGAGRRGRRGLKGRRGEVAFPPRLAIGGAPTSAYSSLPPSCPAPPGDLDQTTMWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENHPTLSSYLHFMFNLRLEIESIPLEMRIKESFRFNRGKKMEI

SEQ ID NO: 855841 - protein, 145 aa, Homo sapiens
KKKKKKYEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMT

SEQ ID NO: 855842 - protein, 367 aa, Homo sapiens; identical to SEQ ID NO: 855827

SEQ ID NO: 855843 - protein, 367 aa, Homo sapiens; identical to SEQ ID NO: 855827

SEQ ID NO: 855844 - protein, 393 aa, Homo sapiens
GGEWGGAGGAGRRGRRGLKGRRGEVAFPPRLAIGGAPTSAYSSLPPSCPAPPGDLDQTTMWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQKLTKRRTENLDIQLAIVKNISFLSYIPSKPSKISVGVTLA

SEQ ID NO: 855845 - protein, 108 aa, Homo sapiens
GGEWGGAGGAGRRGRRGLKGRRGEVAFPPRLAIGGAPTSAYSSLPPSCPAPPGDLDQTTMWKRWLALALALVAVAWVRAEEEIEVLMEHLLCRGSRMGSQHRFSLKVE

SEQ ID NO: 855846 - protein, 124 aa, Homo sapiens
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSIRPTGGRPRLVWLAATIPPGKHED

SEQ ID NO: 855847 - protein, 345 aa, Homo sapiens
MSNNGADLTFGYISCFVAILLFGSNFVPLKKFDTGDGMFLQWVLCAAIWLVALVVNLILHCPKFWPFAMLGGCIWATGNIAVVPIIKTVGLGLGILIWGSFNALTGWASSRFGWFGLDAEEVSNPLLNYIGAGLSVVSAFIFLFIKSEIPNNTCSMDTTPLITEHVINTTQDPCSWVDKLSTVHHRIVGCSLAVISGVLYGSTFVPIIYIKDHSKRNDSIYAGASQYDLDYVFAHFSGIFLTSTVYFLAYCIAMKNSPKLYPEAVLPGFLSGVLWAIATCCWFIANHSLSAVVSFPIITAGPGFIAAMWGIFMFKEIKGLQNYLLMILAFCIILTGALCTAFSEI

SEQ ID NO: 855848 - protein, 160 aa, Homo sapiens
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFCSSKVKYQITRVPWIPLH

SEQ ID NO: 855849 - protein, 160 aa, Homo sapiens; identical to SEQ ID NO: 855848

SEQ ID NO: 855850 - protein, 160 aa, Homo sapiens; identical to SEQ ID NO: 855848

SEQ ID NO: 855851 - protein, 160 aa, Homo sapiens; identical to SEQ ID NO: 855848

SEQ ID NO: 855852 - protein, 160 aa, Homo sapiens; identical to SEQ ID NO: 855848

SEQ ID NO: 855853 - protein, 160 aa, Homo sapiens; identical to SEQ ID NO: 855848

SEQ ID NO: 855854 - protein, 827 aa, Homo sapiens
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANEQEKKGAMSHALNFIKAKQYPPSTQVEVQNDGAESAVFQQLFQKWTASNRTSGLGKTHTVGSVAKVEQVKFDATSMHVKPQVAAQQKMVDDGSGEVQVWRIENLELVPVDSKWLGHFYGGDCYLLLYTYLIGEKQHYLLYVWQGSQASQDEITASAYQAVILDQKYNGEPVQIRVPMGKEPPHLMSIFKGRMVVYQGGTSRTNNLETGPSTRLFQVQGTGANNTKAFEVPARANFLNSNDVFVLKTQSCCYLWCGKGCSGDEREMAKMVADTISRTEKQVVVEGQEPANFWMALGGKAPYANTKRLQEENLVITPRLFECSNKTGRFLATEIPDFNQDDLEEDDVFLLDVWDQVFFWIGKHANEEEKKAAATTAQEYLKTHPSGRDPETPIIVVKQGHEPPTFTGWFLAWDPFKWSNTKSYEDLKAELGNSRDWSQITAEVTSPKVDVFNANSNLSSGPLPIFPLEQLVNKPVEELPEGVDPSRKEEHLSIEDFTQAFGMTPAAFSALPRWKQQNLKKEKGLF

SEQ ID NO: 855855 - protein, 827 aa, Homo sapiens; identical to SEQ ID NO: 855854

SEQ ID NO: 855856 - protein, 780 aa, Homo sapiens
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANEQEKKGAMSHALNFIKAKQYPPSTQVEVQNDGAESAVFQQLFQKWTASNRTSGLGKTHTVGSVAKVEQVKFDATSMHVKPQVAAQQKMVDDGSGEVQVWRIENLELVPVDSKWLGHFYGGDCYLLLYTYLIGEKQHYLLYVWQGSQASQDEITASAYQAVILDQKYNGEPVQIRVPMGKEPPHLMSIFKGRMVVYQGGTSRTNNLETGPSTRLFQVQGTGANNTKAFEVPARANFLNSNDVFVLKTQSCCYLWCGKGCSGDEREMAKMVADTISRTEKQVVVEGQEPANFWMALGGKAPYANTKRLQEENLVITPRLFECSNKTGRFLATEIPDFNQDDLEEDDVFLLDVWDQVFFWIGKHANEEEKKAAATTAQEYLKTHPSGRDPETPIIVVKQGHEPPTFTGWFLAWDPFKWSNTKSYEDLKAELGNSRDWSQITAEHLSIEDFTQAFGMTPAAFSALPRWKQQNLKKEKGLF

SEQ ID NO: 855857 - protein, 72 aa, Homo sapiens
CSSGKMGRGPELRLLLALNTSTLGLPEGVDPSRKEEHLSIEDFTQAFGMTPAAFSALPRWKQQNLKKEKGLF

SEQ ID NO: 855858 - protein, 345 aa, Homo sapiens
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANARFTNLPRSLCKASQAPQMKITGINGDYGQTLVCHSVPFKK

SEQ ID NO: 855859 - protein, 376 aa, Homo sapiens
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANEQEKKGAMSHALNFIKAKQYPPSTQVEVQNDGAESAVFQQLFQKWTASNRTSGLGKTHTVGSVGEGQAGAVR

SEQ ID NO: 855860 - protein, 73 aa, Homo sapiens
QGTGANNTKAFEVPARANFLNSNDVFVLKTQSCCYLWCGKVCSGSRGLPIRKWVLGVPQFRSSPRSGQEPLAN

SEQ ID NO: 855861 - protein, 827 aa, Homo sapiens; identical to SEQ ID NO: 855854

SEQ ID NO: 855862 - protein, 824 aa, Homo sapiens
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANEQEKKGAMSHALNFIKAKQYPPSTQVEVQNDGAESAVFQQLFQKWTASNRTSGLGKTHTVGSVAKVEQVKFDATSMHVKPQVAAQQKMVDDGSGEVQVWRIENLELVPVDSKWLGHFYGGDCYLLLYTYLIGEKQHYLLYVWQGSQASQDEITASAYQAVILDQKYNGEPVQIRVPMGKEPPHLMSIFKGRMVVYQGGTSRTNNLETGPSTRLFQVQGTGANNTKAFEVPARANFLNSNDVFVLKTQSCCYLWCGKGCSGDEREMAKMVADTISRTEKQVVVEGQEPANFWMALGGKAPYANTKRLQEENLVITPRLFECSNKTGRFLATEIPDFNQDDLEEDDVFLLDVWDQVFFWIGKHANEEEKKAAATTAQEYLKTHPSGRDPETPIIVVKQGHEPPTFTGWFLAWDPFKWSNTKSYEDLKAELGNSRDWSQITAEVTSPKVDVFNANSNLSSGPLPIFPLEQLVNKPVEELPEGVDPSRKEEHLSIEDFTQAFGMTPAAFSALPRWKQQNLKKEL

SEQ ID NO: 855863 - protein, 560 aa, Homo sapiens
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANEQEKKGAMSHALNFIKAKQYPPSTQVEVQNDGAESAVFQQLFQKWTASNRTSGLGKTHTVGSVAKVEQVKFDATSMHVKPQVAAQQKMVDDGSGEVQVWRIENLELVPVDSKWLGHFYGGDCYLLLYTYLIGEKQHYLLYVWQGSQASQDEITASAYQAVILDQKYNGEPVQIRVPMGKEPPHLMSIFKGRMVVYQHSLSQPLIMRQSKSLVKANARFTNLPRSLCKASQAPQMKITGINGDYGQTLVCHSVPFKK

SEQ ID NO: 855864 - protein, 780 aa, Homo sapiens; identical to SEQ ID NO: 855856

SEQ ID NO: 855865 - protein, 108 aa, Homo sapiens
MKLQHQLIKPSSWTRSTMVNQSRSGSQWARSHLILCPSSRDAWWSTSVAAELRCLAVTTVARQASGRWRRGWVVGAGLEVKPILHRRLPWRFYHLCGTGNRNNPFGYF

SEQ ID NO: 855866 - protein, 71 aa, Homo sapiens
LQEENLVITPRLFECSNKTGRFLATEIPDFNQDDLEEDDVFLLDVWDQVGPRAWGPLFPATSIPRAKKEWL

SEQ ID NO: 855867 - protein, 247 aa, Homo sapiens
MSGKDRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQTSFVTLDEAIKITNRRVNAIEHVIIPRIERTLAYIITELDEREREEFYRLKKIQEKKKILKEKSEKDLEQRRAAGEVLEPANLLAEEKDEDLLFE

SEQ ID NO: 855868 - protein, 247 aa, Homo sapiens; identical to SEQ ID NO: 855867

SEQ ID NO: 855869 - protein, 247 aa, Homo sapiens; identical to SEQ ID NO: 855867

SEQ ID NO: 855870 - protein, 247 aa, Homo sapiens; identical to SEQ ID NO: 855867

SEQ ID NO: 855871 - protein, 229 aa, Homo sapiens
MSGKDRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQTSFVTLDEAIKITNRRVNAIEHVIIPRIERTLAYIITELDEREREEFYRLKKIQEKKKILKDANLLAEEKDEDLLFE

SEQ ID NO: 855872 - protein, 253 aa, Homo sapiens
YQRRVAITGPGRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQTSFVTLDEAIKITNRRVNAIEHVIIPRIERTLAYIITELDEREREEFYRLKKIQEKKKILKEKSEKDLEQRRAAGEVLEPANLLAEEKDEDLLFE

SEQ ID NO: 855873 - protein, 229 aa, Homo sapiens
MSGKDRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQTSFVTLDEAIKITNRRVNAIEHVIIPRIERTLAYIITELDEREREEFYRLRKPREEKFLRILLKEERDSFDNFLSWP

SEQ ID NO: 855874 - protein, 126 aa, Homo sapiens
MSGKDRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNVAGVTLPVFEHYHEGTDTKQWNYWWN

SEQ ID NO: 855875 - protein, 247 aa, Homo sapiens; identical to SEQ ID NO: 855867

SEQ ID NO: 855876 - protein, 247 aa, Homo sapiens; identical to SEQ ID NO: 855867

SEQ ID NO: 855877 - protein, 247 aa, Homo sapiens; identical to SEQ ID NO: 855867

SEQ ID NO: 855878 - protein, 247 aa, Homo sapiens; identical to SEQ ID NO: 855867

SEQ ID NO: 855879 - protein, 183 aa, Homo sapiens
MSGKDRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQTSFVTLDEAIKITNRRVNAIEHVIIHFNGML

SEQ ID NO: 855880 - protein, 126 aa, Homo sapiens; identical to SEQ ID NO: 855874

SEQ ID NO: 855881 - protein, 69 aa, Homo sapiens
TSRPITEKTTRRKGGSSVPHGGGDWSDVNRKPRNAYSHQKLEESKDTFSPQAPVGARPSWILDFWPPEL

SEQ ID NO: 855882 - protein, 838 aa, Homo sapiens
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRIEISESRVNISCPECTERFNPHDIRLILSDDVLMEKYEEFMLRRWLVADPDCRWCPAPDCGYAVIAFGCASCPKLTCGREGCGTEFCYHCKQIWHPNQTCDAARQERAQSLRLRTIRSSSISYSQESGAAADDIKPCPRCAAYIIKMNDGSCNHMTCAVCGCEFCWLCMKEISDLHYLSPSGCTFWGKKPWSRKKKILWQLGTLVGAPVGIALIAGIAIPAMIIGIPVYVGRKIHNRYEGKDVSKHKRNLAIAGGVTLSVIVSPVVAAVTVGIGVPIMLAYVYGVVPISLCRSGGCGVSAGNGKGVRIEFDDENDINVGGTNTAVDTTSVAEARHNPSIGEGSVGGLTGSLSASGSHMDRIGAIRDNLSETASTMALAGASITGSLSGSAMVNCFNRLEVQADVQKERYSLSGESGTVSLGTVSDNASTKAMAGSILNSYIPLDKEGNSMEVQVDIESKPSKFRHNSGSSSVDDGSATRSHAGGSSSGLPEGKSSATKWSKEATAGKKSKSGKLRKKGNMKINETREDMDAQLLEQQSTNSSEFEAPSLSDSMPSVADSHSSHFSEFSCSDLESMKTSCSHGSSDYHTRFATVNILPEVENDRLENSPHQCSISVVTQTASCSEVSQLNHIAEEHGNNGIKPNVDLYFGDALKETNNNHSHQTMELKVAIQTEI

SEQ ID NO: 855883 - protein, 838 aa, Homo sapiens; identical to SEQ ID NO: 855882

SEQ ID NO: 855884 - protein, 838 aa, Homo sapiens; identical to SEQ ID NO: 855882

SEQ ID NO: 855885 - protein, 838 aa, Homo sapiens; identical to SEQ ID NO: 855882

SEQ ID NO: 855886 - protein, 838 aa, Homo sapiens; identical to SEQ ID NO: 855882

SEQ ID NO: 855887 - protein, 838 aa, Homo sapiens; identical to SEQ ID NO: 855882

SEQ ID NO: 855888 - protein, 838 aa, Homo sapiens; identical to SEQ ID NO: 855882

SEQ ID NO: 855889 - protein, 838 aa, Homo sapiens; identical to SEQ ID NO: 855882

SEQ ID NO: 855890 - protein, 417 aa, Homo sapiens [sequence omitted]

SEQ ID NO: 855891 - protein, 838 aa, Homo sapiens; identical to SEQ ID NO: 855882

SEQ ID NO: 855892 - protein, 838 aa, Homo sapiens; identical to SEQ ID NO: 855882

SEQ ID NO: 855893 - protein, 838 aa, Homo sapiens; identical to SEQ ID NO: 855882

SEQ ID NO: 855894 - protein, 838 aa, Homo sapiens; identical to SEQ ID NO: 855882

SEQ ID NO: 855895 - protein, 503 aa, Homo sapiens
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRIEISESRVNISCPECTERFNPHDIRLILSDDVLMEKYEEFMLRRWLVADPDCRWCPAPDCGYAVIAFGCASCPKLTCGREGCGTEFCYHCKQIWHPNQTCDAARQERAQSLRLRTIRSSSISYSQESGAAADDIKPCPRCAAYIIKMNDGSCNHMTCAVCGCEFCWLCMKEISDLHYLSPSGCTFWGKKPWSRKKKILWQLGTLVGAPVGIALIAGIAIPAMIIGIPVYVGRKIHNRYEGKDVSKHKRNLAIAGGVTLSVIVSPVVAAVTVGIGVPIMLAYVYGVVPISLCRSGGCGVSAGNGKGVRIEFDDENDINVGGTNTAVGWKYKQMYRKNGTV

SEQ ID NO: 855896 - protein, 838 aa, Homo sapiens; identical to SEQ ID NO: 855882

SEQ ID NO: 855897 - protein, 591 aa, Homo sapiens
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRIEISESRVNISCPECTERFNPHDIRLILSDDVLMEKYEEFMLRRWLVADPDCRWCPAPDCGYAVIAFGCASCPKLTCGREGCGTEFCYHCKQIWHPNQTCDAARQERAQSLRLRTIRSSSISYSQESGAAADDIKPCPRCAAYIIKMNDGSCNHMTCAVCGCEFCWLCMKEISDLHYLSPSGCTFWGKKPWSRKKKILWQLGTLVGAPVGIALIAGIAIPAMIIGIPVYVGRKIHNRYEGKDVSKHKRNLAIAGGVTLSVIVSPVVAAVTVGIGVPIMLAYVYGVVPISLCRSGGCGVSAGNGKGVRIEFDDENDINVGGTNTAVDTTSVAEARHNPSIGEGSVGGLTGSLSASGSHMDRIGAIRDNLSETASTMALAGASITGSLSGSAMVNCFNSGSTSRCTERGCCRRCWEMGLLARHPALPPL

SEQ ID NO: 855898 - protein, 634 aa, Homo sapiens
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRIEISESRVNISCPECTERFNPHDIRLILSDDVLMEKYEEFMLRRWLVADPDCRWCPAPDCGYAVIAFGCASCPKLTCGREGCGTEFCYHCKQIWHPNQTCDAARQERAQSLRLRTIRSSSISYSQESGAAADDIKPCPRCAAYIIKMNDGSCNHMTCAVCGCEFCWLCMKEISDLHYLSPSGCTFWGKKPWSRKKKILWQLGTLVGAPVGIALIAGIAIPAMIIGIPVYVGRKIHNRYEGKDVSKHKRNLAIAGGVTLSVIVSPVVAAVTVGIGVPIMLAYVYGVVPISLCRSGGCGVSAGNGKGVRIEFDDENDINVGGTNTAVDTTSVAEARHNPSIGEGSVGGLTGSLSASGSHMDRIGAIRDNLSETASTMALAGASITGSLSGSAMVNCFNRLEVQADVQKERYSLSGESGTVSLGTVSDNASTKARAAEIDDKLNKINDRWQHLFDVIGSRVKKLKETFAFIQQ

SEQ ID NO: 855899 - protein, 225 aa, Homo sapiens
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRIEISESRVNISCPECTERFNPHDIRLILSDDVLMEKYEEFMLRRWLVADPDCRWCPAPDCG

SEQ ID NO: 855900 - protein, 34 aa, Homo sapiens
MRDDKLAQLITRTQARCRGFKVYRYLFTPDPSTF

SEQ ID NO: 855901 - protein, 1909 aa, Homo sapiens
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESGAGKTVNTKRVIQYFATIAVTGEKKKEEITSGKIQGTLEDQIISANPLLEAFGNAKTVRNDNSSRFGKFIRIHFGTTGKLASADIETYLLEKSRVVFQLKAERSYHIFYQITSNKKPELIEMLLITTNPYDYPFVSQGEISVASIDDQEELMATDSAIDILGFTNEEKVSIYKLTGAVMHYGNLKFKQKQREEQAEPDGTEVADKAAYLQSLNSADLLKALCYPRVKVGNEYVTKGQTVEQVSNAVGALAKAVYEKMFLWMVARINQQLDTKQPRQYFIGVLDIAGFEIFDFNSLEQLCINFTNEKLQQFFNHHMFVLEQEEYKKEGIEWTFIDFGMDLAACIELIEKVGPMGIFSILEEECMFPKATDTSFKNKLYDQHLGKSANFQKPKVVKGKAEAHFALIHYAGVVDYNITGWLEKNKDPLNETVVGLYQKSAMKTLAQLFSGAQTAEGEGAGGGAKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLASIDIDHTQYKFGHTKVFFKAGLLGLLEEMRDDKLAQLITRTQARCRGFLARVEYQRMVERREAIFCIQYNIRSFMNVKHWPWMKLFFKIKPLLKSAETEKEMATMKEEFQKIKDELAKSEAKRKELEEKMVTLLKEKNDLQLQVQAEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKLRMDLERAKRKLEGDLKLAQESIMDIENEKQQLDEKLKKKEFEISNLQSKIEDEQALGIQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNVETVSKAKGNLEKMCRTLEDQLSELKSKEEEQQRLINDLTAQRGRLQTESGEFSRQLDEKEALVSQLSRGKQAFTQQIEELKRQLEEEIKAKNALAHALQSSRHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKCEETHAELEASQKEARSLGTELFKIKNAYEESLDQLETLKRENKNLQQEISDLTEQIAEGGKRIHELEKIKKQVEQEKCELQAALEEAEASLEHEEGKILRIQLELNQVKSEVDRKIAEKDEEIDQLKRNHIRIVESMQSTLDAEIRSRNDAIRLKKKMEGDLNEMEIQLNHANRMAAEALRNYRNTQGILKDTQIHLDDALRSQEDLKEQLAMVERRANLLQAEIEELRATLEQTERSRKIAEQELLDASERVQLLHTQNTSLINTKKKLETDISQMQGEMEDILQEARNAEEKAKKAITDAAMMAEELKKEQDTSAHLERMKKNMEQTVKDLQLRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLAKFRKAPA

SEQ ID NO: 855902 - protein, 394 aa, Homo sapiens
MAAASGYTDLREKLKSMTSRDNYKAGSREAAAAAAAAVAAAAAAAAAAEPYPVSGAKRKYQEDSDPERSDYEEQQLQKEEEARKVKSGIRQMRLFSQDECAKIEARIDEVVSRAEKGLYNEHTVDRAPLRNKYFFGEGYTYGAQLQKRGPGQERLYPPGDVDEIPEWVHQLVIQKLVEHRVIPEGFVNSAVINDYQPGGCIVSHVDPIHIFERPIVSVSFFSDSALCFGCKFQFKPIRVSEPVLSLPVRRGSVTVLSGYAADEITHCIRPQDIKERRAVIILRKTRLDAPRLETKSLSSSVLPPSYASDRLSGNNRDPALKPKRSHRKADPDAAHRPRILEMDKEENRRSVLLPTHRRRGSFSSENYWRKSYESSEDCSEAAGSPARKVKMRRH

SEQ ID NO: 855903 - protein, 379 aa, Homo sapiens
GPPAKSIPAIPGGTAAAAAAAAVAAAAAAAAAAEPYPVSGAKRKYQEDSDPERSDYEEQQLQKEEEARKVKSGIRQMRLFSQDECAKIEARIDEVVSRAEKGLYNEHTVDRAPLRNKYFFGEGYTYGAQLQKRGPGQERLYPPGDVDEIPEWVHQLVIQKLVEHRVIPEGFVNSAVINDYQPGGCIVSHVDPIHIFERPIVSVSFFSDSALCFGCKFQFKPIRVSEPVLSLPVRRGSVTVLSGYAADEITHCIRPQDIKERRAVIILRKTRLDAPRLETKSLSSSVLPPSYASDRLSGNNRDPALKPKRSHRKADPDAAHRPRILEMDKEENRRSVLLPTHRRRGSFSSENYWRKSYESSEDCSEAAGSPARKVKMRRH

SEQ ID NO: 855904 - protein, 1218 aa, Homo sapiens
MEHELVLHQLRCNGVLEGIRICRKGFPSRILYADFKQRYKVLNASAIPEGQFIDSKKASEKLLASIDIDHTQYKFGHTKVFFKAGLLGLLEEMRDDKLAQLITRTQARCRGFLARVEYQRMVERREAIFCIQYNIRSFMNVKHWPWMKLFFKIKPLLKSAETEKEMATMKEEFQKIKDELAKSEAKRKELEEKMVTLLKEKNDLQLQVQAEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKLRMDLERAKRKLEGDLKLAQESIMDIENEKQQLDEKLKKKEFEISNLQSKIEDEQALGIQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNVETVSKAKGNLEKMCRTLEDQLSELKSKEEEQQRLINDLTAQRGRLQTESGEFSRQLDEKEALVSQLSRGKQAFTQQIEELKRQLEEEIKAKNALAHALQSSRHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKCEETHAELEASQKEARSLGTELFKIKNAYEESLDQLETLKRENKNLQQEISDLTEQIAEGGKRIHELEKIKKQVEQEKCELQAALEEAEASLEHEEGKILRIQLELNQVKSEVDRKIAEKDEEIDQLKRNHIRIVESMQSTLDAEIRSRNDAIRLKKKMEGDLNEMEIQLNHANRMAAEALRNYRNTQGILKDTQIHLDDALRSQEDLKEQLAMVERRANLLQAEIEELRATLEQTERSRKIAEQELLDASERVQLLHTQNTSLINTKKKLETDISQMQGEMEDILQEARNAEEKAKKAITDAAMMAEELKKEQDTSAHLERMKKNMEQTVKDLQLRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLAKFRKAPA

SEQ ID NO: 855905 - protein, 138 aa, Homo sapiens
MMAEELKKEQDTSAHLERMKKNMEQTVKDLQLRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLAKFRKAPA

SEQ ID NO: 855906 - protein, 394 aa, Homo sapiens; identical to SEQ ID NO: 855902

SEQ ID NO: 855907 - protein, 248 aa, Homo sapiens
LPPAKVLGQPRVDMWKGAVEGSLSTNLLQAEIEELRATLEQTERSRKIAEQELLDASERVQLLHTQNTSLINTKKKLETDISQMQGEMEDILQEARNAEEKAKKAITDAAMMAEELKKEQDTSAHLERMKKNMEQTVKDLQLRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLAKFRKAPA

SEQ ID NO: 855908 - protein, 138 aa, Homo sapiens; identical to SEQ ID NO: 855905

SEQ ID NO: 855909 - protein, 153 aa, Homo sapiens
QRWSSAIMKAITDAAMMAEELKKEQDTSAHLERMKKNMEQTVKDLQLRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLAKFRKAPA

SEQ ID NO: 855910 - protein, 394 aa, Homo sapiens; identical to SEQ ID NO: 855902

SEQ ID NO: 855911 - protein, 1573 aa, Homo sapiens
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESGAGKTVNTKRVIQYFATIAVTGEKKKEEITSGKIQGTLEDQIISANPLLEAFGNAKTVRNDNSSRFGKFIRIHFGTTGKLASADIETYLLEKSRVVFQLKAERSYHIFYQITSNKKPELIEMLLITTNPYDYPFVSQGEISVASIDDQEELMATDSAIDILGFTNEEKVSIYKLTGAVMHYGNLKFKQKQREEQAEPDGTEVADKAAYLQSLNSADLLKALCYPRVKVGNEYVTKGQTVEQVSNAVGALAKAVYEKMFLWMVARINQQLDTKQPRQYFIGVLDIAGFEIFDFNSLEQLCINFTNEKLQQFFNHHMFVLEQEEYKKEGIEWTFIDFGMDLAACIELIEKVGPMGIFSILEEECMFPKATDTSFKNKLYDQHLGKSANFQKPKVVKGKAEAHFALIHYAGVVDYNITGWLEKNKDPLNETVVGLYQKSAMKTLAQLFSGAQTAEGEGAGGGAKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLASIDIDHTQYKFGHTKVFFKAGLLGLLEEMRDDKLAQLITRTQARCRGFLARVEYQRMVERREAIFCIQYNIRSFMNVKHWPWMKLFFKIKPLLKSAETEKEMATMKEEFQKIKDELAKSEAKRKELEEKMVTLLKEKNDLQLQVQAEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKLRMDLERAKRKLEGDLKLAQESIMDIENEKQQLDEKLKKKEFEISNLQSKIEDEQALGIQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNVETVSKAKGNLEKMCRTLEDQLSELKSKEEEQQRLINDLTAQRGRLQTESGEFSRQLDEKEALVSQLSRGKQAFTQQIEELKRQLEEEIKAKNALAHALQSSRHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKCEETHAELEASQKEARSLGTELFKIKNAYEESLDQLETLKRENKNLQQEISDLTEQIAEGGKRIHELEKIKKQVEQEKCELQAALEEAEVTIITSQVWYIFGSDVT

SEQ ID NO: 855912 - protein, 1909 aa, Homo sapiens; identical to SEQ ID NO: 855901

SEQ ID NO: 855913 - protein, 394 aa, Homo sapiens; identical to SEQ ID NO: 855902

SEQ ID NO: 855914 - protein, 1571 aa, Homo sapiens
HVGQAGLELLTSDEPPTLASQSAGTTSMSHRAWQNIKFLIYFNQIADKAAYLQSLNSADLLKALCYPRVKVGNEYVTKGQTVEQVSNAVGALAKAVYEKMFLWMVARINQQLDTKQPRQYFIGVLDIAGFEIFDFNSLEQLCINFTNEKLQQFFNHHMFVLEQEEYKKEGIEWTFIDFGMDLAACIELIEKVGPMGIFSILEEECMFPKATDTSFKNKLYDQHLGKSANFQKPKVVKGKAEAHFALIHYAGVVDYNITGWLEKNKDPLNETVVGLYQKSAMKTLAQLFSGAQTAEGEGAGGGAKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLASIDIDHTQYKFGHTKVFFKAGLLGLLEEMRDDKLAQLITRTQARCRGFLARVEYQRMVERREAIFCIQYNIRSFMNVKHWPWMKLFFKIKPLLKSAETEKEMATMKEEFQKIKDELAKSEAKRKELEEKMVTLLKEKNDLQLQVQAEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKLRMDLERAKRKLEGDLKLAQESIMDIENEKQQLDEKLKKKEFEISNLQSKIEDEQALGIQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNVETVSKAKGNLEKMCRTLEDQLSELKSKEEEQQRLINDLTAQRGRLQTESGEFSRQLDEKEALVSQLSRGKQAFTQQIEELKRQLEEEIKAKNALAHALQSSRHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKCEETHAELEASQKEARSLGTELFKIKNAYEESLDQLETLKRENKNLQQEISDLTEQIAEGGKRIHELEKIKKQVEQEKCELQAALEEAEASLEHEEGKILRIQLELNQVKSEVDRKIAEKDEEIDQLKRNHIRIVESMQSTLDAEIRSRNDAIRLKKKMEGDLNEMEIQLNHANRMAAEALRNYRNTQGILKDTQIHLDDALRSQEDLKEQLAMVERRANLLQAEIEELRATLEQTERSRKIAEQELLDASERVQLLHTQNTSLINTKKKLETDISQMQGEMEDILQEARNAEEKAKKAITDAAMMAEELKKEQDTSAHLERMKKNMEQTVKDLQLRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLAKFRKAPA

SEQ ID NO: 855915 - protein, 466 aa, Homo sapiens
ALKFIETYRRLLAEKIILAEWKQKCEETHAELEASQKEARSLGTELFKIKNAYEESLDQLETLKRENKNLQQEISDLTEQIAEGGKRIHELEKIKKQVEQEKCELQAALEEAEASLEHEEGKILRIQLELNQVKSEVDRKIAEKDEEIDQLKRNHIRIVESMQSTLDAEIRSRNDAIRLKKKMEGDLNEMEIQLNHANRMAAEALRNYRNTQGILKDTQIHLDDALRSQEDLKEQLAMVERRANLLQAEIEELRATLEQTERSRKIAEQELLDASERVQLLHTQNTSLINTKKKLETDISQMQGEMEDILQEARNAEEKAKKAITDAAMMAEELKKEQDTSAHLERMKKNMEQTVKDLQLRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLAKFRKAPA

SEQ ID NO: 855916 - protein, 394 aa, Homo sapiens; identical to SEQ ID NO: 855902

SEQ ID NO: 855917 - protein, 138 aa, Homo sapiens; identical to SEQ ID NO: 855905

SEQ ID NO: 855918 - protein, 394 aa, Homo sapiens; identical to SEQ ID NO: 855902

SEQ ID NO: 855919 - protein, 1558 aa, Homo sapiens
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESGAGKTVNTKRVIQYFATIAVTGEKKKEEITSGKIQGTLEDQIISANPLLEAFGNAKTVRNDNSSRFGKFIRIHFGTTGKLASADIETYLLEKSRVVFQLKAERSYHIFYQITSNKKPELIEMLLITTNPYDYPFVSQGEISVASIDDQEELMATDSAIDILGFTNEEKVSIYKLTGAVMHYGNLKFKQKQREEQAEPDGTEVADKAAYLQSLNSADLLKALCYPRVKVGNEYVTKGQTVEQVSNAVGALAKAVYEKMFLWMVARINQQLDTKQPRQYFIGVLDIAGFEIFDFNSLEQLCINFTNEKLQQFFNHHMFVLEQEEYKKEGIEWTFIDFGMDLAACIELIEKVGPMGIFSILEEECMFPKATDTSFKNKLYDQHLGKSANFQKPKVVKGKAEAHFALIHYAGVVDYNITGWLEKNKDPLNETVVGLYQKSAMKTLAQLFSGAQTAEGEGAGGGAKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLASIDIDHTQYKFGHTKVFFKAGLLGLLEEMRDDKLAQLITRTQARCRGFLARVEYQRMVERREAIFCIQYNIRSFMNVKHWPWMKLFFKIKPLLKSAETEKEMATMKEEFQKIKDELAKSEAKRKELEEKMVTLLKEKNDLQLQVQAEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKLRMDLERAKRKLEGDLKLAQESIMDIENEKQQLDEKLKKKEFEISNLQSKIEDEQALGIQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNVETVSKAKGNLEKMCRTLEDQLSELKSKEEEQQRLINDLTAQRGRLQTESGEFSRQLDEKEALVSQLSRGKQAFTQQIEELKRQLEEEIKAKNALAHALQSSRHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKCEETHAELEASQKEARSLGTELFKIKNAYEESLDQLETLKRENKNLQQEISDLTEQIAEGGKRIHELEKIKKQVEQEKCELQAALEEAECG

SEQ ID NO: 855920 - protein, 924 aa, Homo sapiens
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESGAGKTVNTKRVIQYFATIAVTGEKKKEEITSGKIQGTLEDQIISANPLLEAFGNAKTVRNDNSSRFGKFIRIHFGTTGKLASADIETYLLEKSRVVFQLKAERSYHIFYQITSNKKPELIEMLLITTNPYDYPFVSQGEISVASIDDQEELMATDSAIDILGFTNEEKVSIYKLTGAVMHYGNLKFKQKQREEQAEPDGTEVADKAAYLQSLNSADLLKALCYPRVKVGNEYVTKGQTVEQVSNAVGALAKAVYEKMFLWMVARINQQLDTKQPRQYFIGVLDIAGFEIFDFNSLEQLCINFTNEKLQQFFNHHMFVLEQEEYKKEGIEWTFIDFGMDLAACIELIEKVGPMGIFSILEEECMFPKATDTSFKNKLYDQHLGKSANFQKPKVVKGKAEAHFALIHYAGVVDYNITGWLEKNKDPLNETVVGLYQKSAMKTLAQLFSGAQTAEGEGAGGGAKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLASIDIDHTQYKFGHTKVFFKAGLLGLLEEMRDDKLAQLITRTQARCRGFLARVEYQRMVERREAIFCIQYNIRSFMNVKHWPWMKLFFKIKPLLKSAETEKEMATMKEEFQKIKDELAKSEAKRKELEEKMVTLLKEKNDLQLQVQAEAEGLADAEESWTSIANHSHAEP

SEQ ID NO: 855921 - protein, 142 aa, Homo sapiens
LTSTPSPHHLNEKQTALHSFHLKDVLTTIGEKVCLEVSSCLSLCGSSPFTTDKETVLKGQIQAVASPDDPIRRIMESRILTFLETYLASGHQKPLPTVPGGLSPVQRELEEVAIKFARLVNYNKMVFCPYYDAILSKILVRS

SEQ ID NO: 855922 - protein, 595 aa, Homo sapiens
MSENLDKSNVNEAGKSKSNDSEEGLEDAVEGADEALQKAIKSDSSSPQRVQRPHSSPPRFVTVEELLETARGVTNMALAHEIVVNGDFQIKPVELPENSLKKRVKEIVHKAFWDCLSVQLSEDPPAYDHAIKLVGEIKETLLSFLLPGHTRLRNQITEVLDLDLIKQEAENGALDISKLAEFIIGMMGTLCAPARDEEVKKLKDIKEIVPLFREIFSVLDLMKVDMANFAISSIRPHLMQQSVEYERKKFQEILERQPNSLDFVTQWLEEASEDLMTQKYKHALPVGGMAAGSGDMPRLSPVAVQNYAYLKLLKWDHLQRPFPETVLMDQSRFHELQLQLEQLTILGAVLLVTFSMAAPGISSQADFAEKLKMIVKILLTDMHLPSFHLKDVLTTIGEKVCLEVSSCLSLCGSSPFTTDKETVLKGQIQAVASPDDPIRRIMESRILTFLETYLASGHQKPLPTVPGGLSPVQRELEEVAIKFARLVNYNKMVFCPYYDAILRKRWISFGNFFGSSNTDMSPWNCRTDYPMSLHIRFPKNHVIEAPMTIQLCFQEPCNKALSLLNIPLEAKGILDRSFLQRRLKPYRIRFCCRAL

SEQ ID NO: 855923 - protein, 409 aa, Homo sapiens
MGTLCAPARDEEVKKLKDIKEIVPLFREIFSVLDLMKVDMANFAISSIRPHLMQQSVEYERKKFQEILERQPNSLDFVTQWLEEASEDLMTQKYKHALPVGGMAAGSGDMPRLSPVAVQNYAYLKLLKWDHLQRPFPETVLMDQSRFHELQLQLEQLTILGAVLLVTFSMAAPGISSQADFAEKLKMIVKILLTDMHLPSFHLKDVLTTIGEKVCLEVSSCLSLCGSSPFTTDKETVLKGQIQAVASPDDPIRRIMESRILTFLETYLASGHQKPLPTVPGGLSPVQRELEEVAIKFARLVNYNKMVFCPYYDAILRKRWISFGNFFGSSNTDMSPWNCRTDYPMSLHIRFPKNHVIEAPMTIQLCFQEPCNKALSLLNIPLEAKGILDRSFLQRRLKPYRIRFCCRAL

SEQ ID NO: 855924 - protein, 259 aa, Homo sapiens [sequence omitted]

SEQ ID NO: 855925 - protein, 509 aa, Homo sapiens
MSENLDKSNVNEAGKSKSNDSEEGLEDAVEGADEALQKAIKSDSSSPQRVQRPHSSPPRFVTVEELLETARGVTNMALAHEIVVNGDFQIKPVELPENSLKKRVKEIVHKAFWDCLSVQLSEDPPAYDHAIKLVGEIKETLLSFLLPGHTRLRNQITEVLDLDLIKQEAENGALDISKLAEFIIGMMGTLCAPARDEEVKKLKDIKEIVPLFREIFSVLDLMKVDMANFAISSIRPHLMQQSVEYERKKFQEILERQPNSLDFVTQWLEEASEDLMTQKYKHALPVGGMAAGSGDMPRLSPVAVQNYAYLKLLKWDHLQRPFPETVLMDQSRFHELQLQLEQLTILGAVLLVTFSMAAPGISSQADFAEKLKMIVKILLTDMHLPSFHLKDVLTTIGEKVCLEVSSCLSLCGSSPFTTDKETVLKGQIQAVASPDDPIRRIMESRILTFLETYLASGHQKPLPTVPGGLSPVQRELEEVAIKFARLVNYNKMVFCPYYDAILSKILVRS

SEQ ID NO: 855926 - protein, 595 aa, Homo sapiens; identical to SEQ ID NO: 855922

SEQ ID NO: 855927 - protein, 206 aa, Homo sapiens
DRPPRGEGCGLGGAEAEPPLPAAHPSGFRRGASPRLIRGGSGRRENADSVAGESGSWGGGWRGPSGRRAVQVARISSPLPVGSHPGMSGAGEEEAGSAGGWSSPLEAVLSARPRPPLLPALPLPRWPEQLFTTESGRRARVELSARGGDSRRRGTEPLFFFCRKTLSAGEPLVSSLGPRAAPTDDRLLGKCEDPPPLGSLFRHSGG

SEQ ID NO: 855928 - protein, 153 aa, Homo sapiens
MNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPIILYFLASFYTKYDPTHFILNTASLLSVLIPKMPQLHGVRIFGINKY

SEQ ID NO: 855929 - protein, 153 aa, Homo sapiens; identical to SEQ ID NO: 855928

SEQ ID NO: 855930 - protein, 153 aa, Homo sapiens; identical to SEQ ID NO: 855928

SEQ ID NO: 855931 - protein, 153 aa, Homo sapiens; identical to SEQ ID NO: 855928

SEQ ID NO: 855932 - protein, 153 aa, Homo sapiens; identical to SEQ ID NO: 855928

SEQ ID NO: 855933 - protein, 153 aa, Homo sapiens; identical to SEQ ID NO: 855928

SEQ ID NO: 855934 - protein, 109 aa, Homo sapiens
MNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPIIL

SEQ ID NO: 855935 - protein, 113 aa, Homo sapiens
TRPRTRGAWTLTNIIHNLGMYVFLHAVKGTPFETPDQGKARLLTHWEQLDYGVQFTSSRKFFTISPIILYFLASFYTKYDPTHFILNTASLLSVLIPKMPQLHGVRIFGINKY

SEQ ID NO: 855936 - protein, 182 aa, Homo sapiens
MVFVCYFKVTRKLPVVSVLIHFITSYRANMNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPIILYFLASFYTKYDPTHFILNTASLLSVLIPKMPQLHGVRIFGINKY

SEQ ID NO: 855937 - protein, 153 aa, Homo sapiens; identical to SEQ ID NO: 855928

SEQ ID NO: 855938 - protein, 153 aa, Homo sapiens; identical to SEQ ID NO: 855928

SEQ ID NO: 855939 - protein, 284 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLAAPLLSCRILPCTCASGPLHVLLACCLPLPCTCASVPLHVLLACCLPVLRAPQPSGLHLSWPIFLL

SEQ ID NO: 855940 - protein, 277 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALK

SEQ ID NO: 855941 - protein, 433 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLETLRGELRFDIRKAGTLHGFTAWFSVHFQSLQEGQPPQVLSTGPFHPTTHWKQTLFMMDDPVPVHTGDVVTGSVVLQRNPVWRRHMSVALSWAVTSRQDPTSQKVGEKVFPIWR

SEQ ID NO: 855942 - protein, 277 aa, Homo sapiens; identical to SEQ ID NO: 855940

SEQ ID NO: 855943 - protein, 277 aa, Homo sapiens; identical to SEQ ID NO: 855940

SEQ ID NO: 855944 - protein, 277 aa, Homo sapiens; identical to SEQ ID NO: 855940

SEQ ID NO: 855945 - protein, 277 aa, Homo sapiens; identical to SEQ ID NO: 855940

SEQ ID NO: 855946 - protein, 277 aa, Homo sapiens; identical to SEQ ID NO: 855940

SEQ ID NO: 855947 - protein, 224 aa, Homo sapiens
GQCLRMGGGFPFPLVWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALK

SEQ ID NO: 855948 - protein, 324 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLEVRKR

SEQ ID NO: 855949 - protein, 570 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLETLRGELRFDIRKAGTLHGFTAWFSGTVDIVAINEPFIDLKLHGFYMFHIDSTHGKFHGTDKAENGKLVINGHPSPSSKERDPSQNHVGAEMLALSTSVGVNWESSAAWEKAEVICRGEAKRVIHICPLLECPSRHGCEQWNGCTKALQRHEKAHGKHNREANTDQAKQDKQGEGKGQDPQARKKGRHKESKGPRKRESRTGEHRNNTQHWRQRGDVQTRRMRQQPTKMRSSRNNKAESQTQSTLAGTKRL

SEQ ID NO: 855950 - protein, 234 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLGEGGRAGSWGPELGGF

SEQ ID NO: 855951 - protein, 234 aa, Homo sapiens; identical to SEQ ID NO: 855950

SEQ ID NO: 855952 - protein, 115 aa, Homo sapiens
SNSLTGRAERRKDSAESGVENWAQEAQMLETFLTEASELTMRVLGVVSPGWGAFLRFLTHSASARGAWRGPPQPGPCGATRCPRVPCHLLDPDPEGRAALRHQEGGDPARLHGLV

SEQ ID NO: 855953 - protein, 146 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLRNPVWRRHMSVALSWAVTSRQDPTSQKVGEKVFPIWR

SEQ ID NO: 855954 - protein, 113 aa, Homo sapiens
MATSGDCPRSESQGEEPAECSEAGLLQEGVQPEEFVAIADYAATDETQLSFLRGEKILILRQTTADWWWGERAGCCGYIPANHVGKSRLCFQVFTRGAHSADPWLGRSSMFLS

SEQ ID NO: 855955 - protein, 433 aa, Homo sapiens; identical to SEQ ID NO: 855941

SEQ ID NO: 855956 - protein, 277 aa, Homo sapiens; identical to SEQ ID NO: 855940

SEQ ID NO: 855957 - protein, 433 aa, Homo sapiens; identical to SEQ ID NO: 855941

SEQ ID NO: 855958 - protein, 433 aa, Homo sapiens; identical to SEQ ID NO: 855941

SEQ ID NO: 855959 - protein, 277 aa, Homo sapiens; identical to SEQ ID NO: 855940

SEQ ID NO: 855960 - protein, 277 aa, Homo sapiens; identical to SEQ ID NO: 855940

SEQ ID NO: 855961 - protein, 334 aa, Homo sapiens
GAPGPGRGLPGWRPACTALARVEGGGSGSWKGPSTPPRWRCGRGTQRRNAIESSVWITLSLEKYELRRRKGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALK

SEQ ID NO: 855962 - protein, 257 aa, Homo sapiens
MATSGDCPRSESQGEEPAECSEAGLLQEGVQPEEFVAIADYAATDETQWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALK

SEQ ID NO: 855963 - protein, 228 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLVGEKVFPIWR

SEQ ID NO: 855964 - protein, 217 aa, Homo sapiens [sequence omitted]

SEQ ID NO: 855965 - protein, 284 aa, Homo sapiens; identical to SEQ ID NO: 855939

SEQ ID NO: 855966 - protein, 74 aa, Homo sapiens
HAPLSCSTTHWKQTLFMMDDPVPVHTGDVVTGSVVLQRNPVWRRHMSVALSWAVTSRQDPTSQKVGEKVFPIWR

SEQ ID NO: 855967 - protein, 126 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLWAGCPRVMVLGKRCWLG

SEQ ID NO: 855968 - protein, 495 aa, Homo sapiens
MKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEDLQDLFRKTGQDVDGKLTYQEIWTSLGSAMPEPESLRAFDSDGDGRYSFLELRVALGI

SEQ ID NO: 855969 - protein, 495 aa, Homo sapiens; identical to SEQ ID NO: 855968

SEQ ID NO: 855970 - protein, 495 aa, Homo sapiens; identical to SEQ ID NO: 855968

SEQ ID NO: 855971 - protein, 273 aa, Homo sapiens
MELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEDLQDLFRKTGQDVDGKLTYQEIWTSLGSAMPEPESLRAFDSDGDGRYSFLELRVALGI

SEQ ID NO: 855972 - protein, 443 aa, Homo sapiens
THASALSLAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEDLQDLFRKTGQDVDGKLTYQEIWTSLGSAMPEPESLRAFDSDGDGRYSFLELRVALGI

SEQ ID NO: 855973 - protein, 332 aa, Homo sapiens
SFSRITQEQFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEDLQDLFRKTGQDVDGKLTYQEIWTSLGSAMPEPESLRAFDSDGDGRYSFLELRVALGI

SEQ ID NO: 855974 - protein, 495 aa, Homo sapiens; identical to SEQ ID NO: 855968

SEQ ID NO: 855975 - protein, 77 aa, Homo sapiens
RVISRERVIPRERVISRERVIPRERVITRERVIPRERVISRKRVYPRKPYPLRFYLEANQEPNMFLWGMTKAKKAVR

SEQ ID NO: 855976 - protein, 495 aa, Homo sapiens; identical to SEQ ID NO: 855968

SEQ ID NO: 855977 - protein, 425 aa, Homo sapiens
MKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEGESRAGFLIFHGGLSSLPLTWGAGKVFQQY

SEQ ID NO: 855978 - protein, 33 aa, Homo sapiens
MNETVSNLTQRVNLIESDVVAMSKVEKKANLSF

SEQ ID NO: 855979 - protein, 495 aa, Homo sapiens; identical to SEQ ID NO: 855968

SEQ ID NO: 855980 - protein, 539 aa, Homo sapiens
RPPPPQPPPPTLTLEGSSKAGRELGIGYEPGSSGVGAPLTPHKKMKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEDLQDLFRKTGQDVDGKLTYQEIWTSLGSAMPEPESLRAFDSDGDGRYSFLELRVALGI

SEQ ID NO: 855981 - protein, 431 aa, Homo sapiens
MKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEDLQDLFRKTGQDVDGKLTYQEIWTSLGSAMPEPESLRAFDSDGDGRYSFLELRVALGI

SEQ ID NO: 855982 - protein, 477 aa, Homo sapiens
MKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEEQVESFTSKPSALPISLPGVSSTEDLQDLFRKTGQDVDGKLTYQEIWTSLGSAMPEPESLRAFDSDGDGRYSFLELRVALGI

SEQ ID NO: 855983 - protein, 166 aa, Homo sapiens [sequence omitted]

SEQ ID NO: 855984 - protein, 495 aa, Homo sapiens; identical to SEQ ID NO: 855968

SEQ ID NO: 855985 - protein, 455 aa, Homo sapiens
MKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEGKFLYHGVVMGMFKVITF

SEQ ID NO: 855986 - protein, 121 aa, Homo sapiens
SAAYWQAAQAAAAKGEVIWGWSDGPGLELAAAAAAAAATNANNNVSGAAAAEAGAGAGVAAGVGPARVSGRELPVPETSNSGRERFRSAEPPSPAAPCPQGPDSGAGVYQARDWLLSGRPF

SEQ ID NO: 855987 - protein, 281 aa, Homo sapiens
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 855988 - protein, 281 aa, Homo sapiens; identical to SEQ ID NO: 855987

SEQ ID NO: 855989 - protein, 281 aa, Homo sapiens; identical to SEQ ID NO: 855987

SEQ ID NO: 855990 - protein, 281 aa, Homo sapiens; identical to SEQ ID NO: 855987

SEQ ID NO: 855991 - protein, 281 aa, Homo sapiens; identical to SEQ ID NO: 855987

SEQ ID NO: 855992 - protein, 446 aa, Homo sapiens
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLEVIWPRPHPRTGLNPYMALPFISRPSVAWEGRAQGGRSPPRPSRRSTQHRRVGAAQLQGALIGCTQGKPPAIGCDLPPLSPQMTVMVLSVQLQRRALRRKCEPHVPGAGDSSPGPSLIADGGGGHSGSLWGGWGMAGACPNWGDKAPQGKLPMALGLWPLWVQDEDQPDTGSAGAELEEAQLEAEAEGEDR

SEQ ID NO: 855993 - protein, 394 aa, Homo sapiens
FLSLSALRLSFSLSLFLSPCLPHCQHLFCVVSGPLTPLGEDVSPGELPQPHQVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLEMTVMVLSVQLQRRALRRKCEPHVPGAGDSSPGPSLIADGGGGHSGSLWGGWGMAGACPNWGDKAPQGKLPMALGLWPLWVQDEDQPDTGSAGAELEEAQLEAEAEGEDR

SEQ ID NO: 855994 - protein, 51 aa, Homo sapiens
IDKTSFVSFVGEGGWGRWEGLPQPKQLPGVSLVSGRPTVPYSAGRLQAPIH

SEQ ID NO: 855995 - protein, 281 aa, Homo sapiens; identical to SEQ ID NO: 855987

SEQ ID NO: 855996 - protein, 281 aa, Homo sapiens; identical to SEQ ID NO: 855987

SEQ ID NO: 855997 - protein, 446 aa, Homo sapiens; identical to SEQ ID NO: 855992

SEQ ID NO: 855998 - protein, 310 aa, Homo sapiens
FLSLSALRLSFSLSLFLSPCLPHCQHLFCVVSGPLTPLGEDVSPGELPQPHQVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 855999 - protein, 253 aa, Homo sapiens
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYRELGFMTLSIFLCRNLDHVYNRLARYR

SEQ ID NO: 856000 - protein, 251 aa, Homo sapiens
MPEDGEGWPEKNAGPGLESPRKNPFNFSLHPPGLRAGPPEVAAQQPYFHSGHLPGRRPTRGDLAPPPPANGPKSLDGPALHFSVLRLPGKDELRAERSPPRPSRRSTQHRRVGAAQLQGALIGCTQGKPPAIGCDLPPLSPQMTVMVLSVQLQRRALRRKCEPHVPGAGDSSPGPSLIADGGGGHSGSLWGGWGMAGACPNWGDKAPQGKLPMALGLWPLWVQDEDQPDTGSAGAELEEAQLEAEAEGEDR

SEQ ID NO: 856001 - protein, 747 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDRLISDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFLAYQTVVLDPEMGSSRSP

SEQ ID NO: 856002 - protein, 582 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGAGLGLKGWLGDL

SEQ ID NO: 856003 - protein, 768 aa, Homo sapiens
PSRGGPRSGTALSARRASECHGASSKWSPEPLKARQVWRAGSCAPGPVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDRLISDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFLAYQTVVLDPEMGSSRSP

SEQ ID NO: 856004 - protein, 647 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQVQGDGKDRGGMRVLMDEAPALWMESGQITLFRVIKRRW

SEQ ID NO: 856005 - protein, 233 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAGNTETCLLTLDHGSCGLW

SEQ ID NO: 856006 - protein, 737 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDRLISDGDGHQDTKDNCPQLPNSSQLDSDNDGLGDECDGDDDNDGIPDYVPPGPDNCRLVPNPNQKDSDVARAFLSTQPHSAQAMALVMCVRMTLTMMLWSTPWMCVLKVQR

SEQ ID NO: 856007 - protein, 648 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDRMLFVSPSRVEPGKVQPIKAMG

SEQ ID NO: 856008 - protein, 550 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEASPMDWTIALKSPTHYRQTGMRTGWEMLATAALK

SEQ ID NO: 856009 - protein, 116 aa, Homo sapiens
VSRAPAASTPCPASTVRPVLEGTRAHRCLVWALTMPGPANRSDWVVCVDKGSWPCRGQGLLGWTWDPCDEWDMDGFASALGLGLMLMFTDKAIPVSSAVSEETHHRSGSTQSLPLQ

SEQ ID NO: 856010 - protein, 320 aa, Homo sapiens
MPMYQVKPYHGGGAPLRVELPTCMYRLPNVHGRSYGPAPGAGHVQEESNLSLQALESRQDDILKRLYELKAAVDGLSKMIQTPDADLDVTNIIQADEPTTLTTNALDLNSVLGKDYGALKDIVINANPASPPLSLLVLHRLLCEHFRVLSTVHTHSSVKSVPENLLKCFGEQNKKQPRQDYQLGFTLIWKNVPKTQMKFSIQTMCPIEGEGNIARFLFSLFGQKHNAVNATLIDSWVDIAIFQLKEGSSKEKAAVFRSMNSALGKSPWLAGNELTVADVVLWSVLQQIGGCSVTVPANVQRWMRSCENLAPFNTALKLLK

SEQ ID NO: 856011 - protein, 280 aa, Homo sapiens
MPMYQEESNLSLQALESRQDDILKRLYELKAAVDGLSKMIQTPDADLDVTNIIQADEPTTLTTNALDLNSVLGKDYGALKDIVINANPASPPLSLLVLHRLLCEHFRVLSTVHTHSSVKSVPENLLKCFGEQNKKQPRQDYQLGFTLIWKNVPKTQMKFSIQTMCPIEGEGNIARFLFSLFGQKHNAVNATLIDSWVDIAIFQLKEGSSKEKAAVFRSMNSALGKSPWLAGNELTVADVVLWSVLQQIGGCSVTVPANVQRWMRSCENLAPFNTALKLLK

SEQ ID NO: 856012 - protein, 242 aa, Homo sapiens
MIQTPDADLDVTNIIQADEPTTLTTNALDLNSVLGKDYGALKDIVINANPASPPLSLLVLHRLLCEHFRVLSTVHTHSSVKSVPENLLKCFGEQNKKQPRQDYQLGFTLIWKNVPKTQMKFSIQTMCPIEGEGNIARFLFSLFGQKHNAVNATLIDSWVDIAIFQLKEGSSKEKAAVFRSMNSALGKSPWLAGNELTVADVVLWSVLQQIGGCSVTVPANVQRWMRSCENLAPFNTALKLLK

SEQ ID NO: 856013 - protein, 242 aa, Homo sapiens; identical to SEQ ID NO: 856012

SEQ ID NO: 856014 - protein, 320 aa, Homo sapiens; identical to SEQ ID NO: 856010

SEQ ID NO: 856015 - protein, 251 aa, Homo sapiens
MPMYQVKPYHGGGAPLRVELPTCMYRLPNVHGRSYGPAPGAGHVQDYGALKDIVINANPASPPLSLLVLHRLLCEHFRVLSTVHTHSSVKSVPENLLKCFGEQNKKQPRQDYQLGFTLIWKNVPKTQMKFSIQTMCPIEGEGNIARFLFSLFGQKHNAVNATLIDSWVDIAIFQLKEGSSKEKAAVFRSMNSALGKSPWLAGNELTVADVVLWSVLQQIGGCSVTVPANVQRWMRSCENLAPFNTALKLLK

SEQ ID NO: 856016 - protein, 349 aa, Homo sapiens
MPMYQVKPYHGGGAPLRVELPTCMYRLPNVHGRSYGPAPGAGHVQKWSFIMLSSRTPDLKVIHPPRPSKVLRLQEESNLSLQALESRQDDILKRLYELKAAVDGLSKMIQTPDADLDVTNIIQADEPTTLTTNALDLNSVLGKDYGALKDIVINANPASPPLSLLVLHRLLCEHFRVLSTVHTHSSVKSVPENLLKCFGEQNKKQPRQDYQLGFTLIWKNVPKTQMKFSIQTMCPIEGEGNIARFLFSLFGQKHNAVNATLIDSWVDIAIFQLKEGSSKEKAAVFRSMNSALGKSPWLAGNELTVADVVLWSVLQQIGGCSVTVPANVQRWMRSCENLAPFNTALKLLK

SEQ ID NO: 856017 - protein, 567 aa, Homo sapiens
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSRMEILLLMVDDSPLIVEWRTPDGRNRPSHVWLCDLPAASLNDQLPQHTFRVIWTAGDVQKECVLLKGRQEGWCRDSTTDEQLFRCELSVEKSTVLQSELESCKELQELEPENKWCLLTIILLMRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNRLQQPAVLQPLASCPRLVLLNLQGNPLCQAVGILEQLAELLPSVSSVLT

SEQ ID NO: 856018 - protein, 156 aa, Homo sapiens
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNSAPPAGFWTTGAPP

SEQ ID NO: 856019 - protein, 567 aa, Homo sapiens; identical to SEQ ID NO: 856017

SEQ ID NO: 856020 - protein, 624 aa, Homo sapiens
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSRMEILLLMVDDSPLIVEWRTPDGRNRPSHVWLCDLPAASLNDQLPQHTFRVIWTAGDVQKECVLLKGRQEGWCRDSTTDEQLFSVVIGKHKTRRGALDSGHQAARAGGWGLKELFQSRYWECCPVLQGCGPQLLPTLPTLRCELSVEKSTVLQSELESCKELQELEPENKWCLLTIILLMRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNRLQQPAVLQPLASCPRLVLLNLQGNPLCQAVGILEQLAELLPSVSSVLT

SEQ ID NO: 856021 - protein, 599 aa, Homo sapiens
MVAPYEPRAPQCGVFAGQLLQGNLHSSNPFILVHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSRMEILLLMVDDSPLIVEWRTPDGRNRPSHVWLCDLPAASLNDQLPQHTFRVIWTAGDVQKECVLLKGRQEGWCRDSTTDEQLFRCELSVEKSTVLQSELESCKELQELEPENKWCLLTIILLMRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNRLQQPAVLQPLASCPRLVLLNLQGNPLCQAVGILEQLAELLPSVSSVLT

SEQ ID NO: 856022 - protein, 584 aa, Homo sapiens
MVSFCKATCTLPTRSSLEHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSRMEILLLMVDDSPLIVEWRTPDGRNRPSHVWLCDLPAASLNDQLPQHTFRVIWTAGDVQKECVLLKGRQEGWCRDSTTDEQLFRCELSVEKSTVLQSELESCKELQELEPENKWCLLTIILLMRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNRLQQPAVLQPLASCPRLVLLNLQGNPLCQAVGILEQLAELLPSVSSVLT

SEQ ID NO: 856023 - protein, 540 aa, Homo sapiens [sequence omitted]

SEQ ID NO: 856024 - protein, 541 aa, Homo sapiens
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSRMEILLLMVDDSPLIVEWRTPDGRNRPSHVWLCDLPAASLNDQLPQHTFRVIWTAGDVQKECVLLKGRQEGWCRDSTTDEQLFRCELSVEKSTVLQSELESCKELQELEPENKWCLLTIILLMRALDPLLYEKETLQYFQTLKAVDPMRATYLDDLRSKFLLENSVLKMEYAEVRVLHLAHKVWAAMHAFPWPSSRWPPHVPDFAPSLRCLCGLPIKIEFIPASQLAPLPGLSVTQPILLLATHFQIPSHQDLLVLFLPQAGHSFIFLQSDR

SEQ ID NO: 856025 - protein, 176 aa, Homo sapiens
MRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNRLQQPAVLQPLASCPRLVLLNLQGNPLCQAVGILEQLAELLPSVSSVLT

SEQ ID NO: 856026 - protein, 224 aa, Homo sapiens
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKGLLSTYFMRGSRGA

SEQ ID NO: 856027 - protein, 133 aa, Homo sapiens
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWPPAACSAPASCLLPQAGPPQPAG

SEQ ID NO: 856028 - protein, 98 aa, Homo sapiens
SVAEPSLADSACPASLPSLPVLQASDNAIESLDGVTNLPRLQELLLCNNRLQQPAVLQPLASCPRLVLLNLQGNPLCQAVGILEQLAELLPSVSSVLT

SEQ ID NO: 856029 - protein, 567 aa, Homo sapiens; identical to SEQ ID NO: 856017

SEQ ID NO: 856030 - protein, 567 aa, Homo sapiens; identical to SEQ ID NO: 856017

SEQ ID NO: 856031 - protein, 584 aa, Homo sapiens; identical to SEQ ID NO: 856022

SEQ ID NO: 856032 - protein, 567 aa, Homo sapiens; identical to SEQ ID NO: 856017

SEQ ID NO: 856033 - protein, 369 aa, Homo sapiens
MCAKGAPEDVLLKLELVQNAFFTDPNDQSAWFYHRWLLGRADPQDALRCLHVSRDEACLTVSFSRPLLVGSRMEILLLMVDDSPLIVEWRTPDGRNRPSHVWLCDLPAASLNDQLPQHTFRVIWTAGDVQKECVLLKGRQEGWCRDSTTDEQLFRCELSVEKSTVLQSELESCKELQELEPENKWCLLTIILLMRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNRLQQPAVLQPLASCPRLVLLNLQGNPLCQAVGILEQLAELLPSVSSVLT

SEQ ID NO: 856034 - protein, 273 aa, Homo sapiens
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKELELVQNAFFTDPNDQSAWFYHRWLLGRVTPGSLAADVTGQAAAALFGLYGSDELVYVYLLWE

SEQ ID NO: 856035 - protein, 211 aa, Homo sapiens
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKG

SEQ ID NO: 856036 - protein, 217 aa, Homo sapiens
MSGGLAPSKSTVYVSNLPFSLTNNDLYRIFSKYGKVVKVTIMKDKDTRKSKGVAFILFLDKDSAQNCTRAINNKQLFGRVIKASIAIDNGRAAEFIRRRNYFDKSKCYECGESGHLSYACPKNMLGEREPPKKKEKKKKKKAPEPEEEIEEVEESEDEGEDPALDSLSQAIAFQQAKIEEEQKKWKPSSGVPSTSDDSRRPRIKKSTYFSDEEELSD

SEQ ID NO: 856037 - protein, 217 aa, Homo sapiens; identical to SEQ ID NO: 856036

SEQ ID NO: 856038 - protein, 217 aa, Homo sapiens; identical to SEQ ID NO: 856036

SEQ ID NO: 856039 - protein, 176 aa, Homo sapiens
MKDKDTRKSKGVAFILFLDKDSAQNCTRAINNKQLFGRVIKASIAIDNGRAAEFIRRRNYFDKSKCYECGESGHLSYACPKNMLGEREPPKKKEKKKKKKAPEPEEEIEEVEESEDEGEDPALDSLSQAIAFQQAKIEEEQKKWKPSSGVPSTSDDSRRPRIKKSTYFSDEEELSD

SEQ ID NO: 856040 - protein, 250 aa, Homo sapiens
MSGGLAPSKSTVYVSNLPFSLTNNDLYRIFSKYGKVVKVTIMKDKDTRKSKGVAFILFLDKDSAQNCTRAINNKQLFGRVIKASIAIDNGRAAEFIRRRNYFDKSKCYECGGHLSYACPKQYARQNVSLHRRNYFDKSKCYECGESGHLSYACPKNMLGEREPPKKKEKKKKKKAPEPEEEIEEVEESEDEGEDPALDSLSQAIAFQQAKIEEEQKKWKPSSGVPSTSDDSRRPRIKKSTYFSDEEELSD

SEQ ID NO: 856041 - protein, 146 aa, Homo sapiens
MSGGLAPSKSTVYVSNLPFSLTNNDLYRIFSKYGKVVKVTIMKDKDTRKSKGVAFILFLDKDSAQNCTRAINNKQLFGRVIKASIAIDNGRAAEFIRRRNYFDKSKCYECGESGHLSYACPKNMLGEREPPKKKEKKKKTSNPIKK

SEQ ID NO: 856042 - protein, 176 aa, Homo sapiens; identical to SEQ ID NO: 856039

SEQ ID NO: 856043 - protein, 176 aa, Homo sapiens; identical to SEQ ID NO: 856039

SEQ ID NO: 856044 - protein, 784 aa, Homo sapiens
MLVSRELLAEDPRPCRRLVGAVCRVLTQSACVMRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRNRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856045 - protein, 643 aa, Homo sapiens
ANSARGRRSEDVTCYLSLLLAGGENLHLKISRVRKRNLPFVVWGEEEASTPGLDAISHHLCYPDRTHRDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856046 - protein, 604 aa, Homo sapiens
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856047 - protein, 383 aa, Homo sapiens
MLVSRELLAEDPRPCRRLVGAVCRVLTQSACVMRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRNRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKRYCTVHWSVKYFKPYCC

SEQ ID NO: 856048 - protein, 643 aa, Homo sapiens; identical to SEQ ID NO: 856045

SEQ ID NO: 856049 - protein, 807 aa, Homo sapiens
MLVSRELLAEDPRPCRRLVGAVCRVLTQSACVMRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRNETPLEKLRCLRSKIICSWWHPPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856050 - protein, 567 aa, Homo sapiens
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856051 - protein, 604 aa, Homo sapiens; identical to SEQ ID NO: 856046

SEQ ID NO: 856052 - protein, 721 aa, Homo sapiens
ANSARGRRSEDVTCYLSLLLAGGENLHLKISRVRKRNLPFVVWGEEEASTPGLDAISHHLCYPDRTHRDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDSYFPTSSFQYFIFECIVTFDYPCTVLRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALEMKAIPRCCPALSIAVLGHMRSHCFSKGYQLIPSCILMAALAVSSIQWSPSCHAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856053 - protein, 427 aa, Homo sapiens
MFIFECIVTFDYPCTVLRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALEMKAIPRCCPALSIAVLGHMRSHCFSKGYQLIPSCILMAALAVSSIQWSPSCHAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856054 - protein, 352 aa, Homo sapiens
MAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALEMKAIPRCCPALSIAVLGHMRSHCFSKGYQLIPSCILMAALAVSSIQWSPSCHAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856055 - protein, 184 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRNKPHLKN

SEQ ID NO: 856056 - protein, 577 aa, Homo sapiens
MPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856057 - protein, 567 aa, Homo sapiens; identical to SEQ ID NO: 856050

SEQ ID NO: 856058 - protein, 395 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRNRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDR

SEQ ID NO: 856059 - protein, 242 aa, Homo sapiens
ANSARGRRSEDVTCYLSLLLAGGENLHLKISRVRKRNLPFVVWGEEEASTPGLDAISHHLCYPDRTHRDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKRYCTVHWSVKYFKPYCC

SEQ ID NO: 856060 - protein, 830 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRSARAQHPASGDAAPAPLMALLICCHSFQNRRHEPGTRLLLGDSHFLCGTLDSRMPDETPLEKLRCLRSKIICSWWHPPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856061 - protein, 567 aa, Homo sapiens; identical to SEQ ID NO: 856050

SEQ ID NO: 856062 - protein, 695 aa, Homo sapiens
ANSARGRRSEDVTCYLSLLLAGGENLHLKISRVRKRNLPFVVWGEEEASTPGLDAISHHLCYPDRTHRDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALEMKAIPRCCPALSIAVLGHMRSHCFSKGYQLIPSCILMAALAVSSIQWSPSCHAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856063 - protein, 583 aa, Homo sapiens
MTVTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALEMKAIPRCCPALSIAVLGHMRSHCFSKGYQLIPSCILMAALAVSSIQWSPSCHAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856064 - protein, 689 aa, Homo sapiens
ANSARGRRSEDVTCYLSLLLAGGENLHLKISRVRKRNLPFVVWGEEEASTPGLDAISHHLCYPDRTHRDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRMNKLRSRELSDLTKVTQLVMEEPGLDLRSLDSQSSALFHYTTMPVRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 856065 - protein, 117 aa, Homo sapiens
MMKQTLVFSPFRTKENGFDREPLHSEHPSKRPCTISPGQRYSPNNGLSYQPNGLPHPTPPPPQHYRLDDMAIAHHYRDSYRHPSHRDLRDRNRPMGKTEGPVHFLRDWVLEDLHHYF

SEQ ID NO: 856066 - protein, 175 aa, Homo sapiens
ENCGYKFCGRTHMYKHAQHHDRVDNLVLDDFKRFKASLSCHFADCPFSGTSTHFHCLRCRFRCTDSTKVTAHRKHHGKQDVISAAGFCQFSSSADCAVPDCKYKLKCSHFHCTFPGCRHTVVGMSQMDSHKRKHEKQERGEPAAEGPAPGPPISLDGSLSLGAEPGSLLFLQSAA

SEQ ID NO: 856067 - protein, 174 aa, Homo sapiens
NAGLAWLRQRHQHQRAQPGVLFFADDDNTYSLELFQEMRTTRKVSVWPVGLVGGRRYERPLVENGKVVGWYTGWRADRPFAIDMAGFAVSLQVILSNPKAVFKRRGSQPGMQESDFLKQITTVEELEPKANNCTKVFITLVLPDLECHHEECATQAISFPFRFSCGTLGQRRLI

SEQ ID NO: 856068 - protein, 283 aa, Homo sapiens
GSPCPPACTPCRSSLREPAAPPRPGSEPRGSRSLQRPRPHGQRTHHHSLSAGAAAVQAAHWGPSARPSLGCPRGQGACTMKSALFTRFFILLPWILIVIIMLDVDTRRPVPPLTPRPYFSPYAVGRGGARLPLRRGGPAHGTQKRNQSRPQPQPEPQLPTIYAITPTYSRPVQKAELTRLANTFRQVAQLHWILVEDAAARSELVSRFLARAGLPSTHLHVPTPRRYKRPGLPRATEQRNAGLAWLRQRHQHQRAQPGVLFFADDDNTYSLELFQEVKASLPR

SEQ ID NO: 856069 - protein, 163 aa, Homo sapiens
NAGLAWLRQRHQHQRAQPGVLFFADDDNTYSLELFQEMRTTRKVSVWPVGLVGGRRYERPLVENGKVVGWYTGWRADRPFAIDMAGFAVSLQVILSNPKAVFKRRGSQPGMQESDFLKQITTVEELEPKANNCTKVLVWHTRTEKVNLANEPKYHLDTVKIEV

SEQ ID NO: 856070 - protein, 90 aa, Homo sapiens
KGFAVSLQVILSNPKAVFKRRGSQPGMQESDFLKQITTVEELEPKANNCTKVFITLVLPDLECHHEECATQAISFPFRFSCGTLGQRRLI

SEQ ID NO: 856071 - protein, 581 aa, Homo sapiens
PQAHTESMSIQENISSLQLRSWVSKSQRDLAKSILIGAPGGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 856072 - protein, 581 aa, Homo sapiens; identical to SEQ ID NO: 856071

SEQ ID NO: 856073 - protein, 565 aa, Homo sapiens
PLTTQQCGADPQRGRPREVCSGMEGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 856074 - protein, 581 aa, Homo sapiens; identical to SEQ ID NO: 856071

SEQ ID NO: 856075 - protein, 556 aa, Homo sapiens
MSIQENISSLQLRSWVSKSQRDLAKSILIGAPGGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVQGCSGSGRTRHQDHHDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 856076 - protein, 145 aa, Homo sapiens
AAVAFGSGALMLGMFVLQLGVLSTFLSEPVVKALTSGAALHVLLSQLPSLLGLSLPRQIGCFSLFKTLASLLTALPRSSPAELTISALSLALLVPVKELNVRFRDRLPTPIPGEVVLVLLASVLCFTSSVDTRYQVQIVGLLPGG

SEQ ID NO: 856077 - protein, 88 aa, Homo sapiens
MSPGTGPSAHRPCPQTLASLLTALPRSSPAELTISALSLALLVPVKELNVRFRDRLPTPIPGEVVLVRMAVRAGPLPAQTLRSCGNWP

SEQ ID NO: 856078 - protein, 136 aa, Homo sapiens
LYGFRGSLEGVRSTGGLPTFFLHYLTASGGCWDTGDSGPGSTQSSSRPGNTSSSSRPPPPPPRRFLLRLPASFAPPRPRSASGPPAGQLLSGASTQAHGSMKQEEEAERERSRPPQPRLGQEKSKTIFLLLSVLMH

SEQ ID NO: 856079 - protein, 136 aa, Homo sapiens; identical to SEQ ID NO: 856078

SEQ ID NO: 856080 - protein, 136 aa, Homo sapiens; identical to SEQ ID NO: 856078

SEQ ID NO: 856081 - protein, 136 aa, Homo sapiens; identical to SEQ ID NO: 856078

SEQ ID NO: 856082 - protein, 136 aa, Homo sapiens; identical to SEQ ID NO: 856078

SEQ ID NO: 856083 - protein, 136 aa, Homo sapiens; identical to SEQ ID NO: 856078

SEQ ID NO: 856084 - protein, 136 aa, Homo sapiens; identical to SEQ ID NO: 856078

SEQ ID NO: 856085 - protein, 96 aa, Homo sapiens
MNHNKFVKCKKTSAVLGSINPVYNETFSFKADATKLDTASLSLTAVQNMEGDSKATPYPGLLGWGPRGAAECSGRVSASCPDLKKELYELPPWLRK

SEQ ID NO: 856086 - protein, 104 aa, Homo sapiens
MFQPPRQRVGPSGASQKTEGFLLRLLYSGLIIAHCSLEILGRNDPPASASKVAETTDSSSLMKVSIPPIKSVSDNTNIWVISGSVLLCLFSPPSCFVVCLITYC

SEQ ID NO: 856087 - protein, 136 aa, Homo sapiens; identical to SEQ ID NO: 856078

SEQ ID NO: 856088 - protein, 172 aa, Homo sapiens
PGCQVSLMNHNKLSSARRLQLQRVGPSGASQKTEGFLLRLLYSGLIIAHCSLEILGRNDPPASASKVAETTGVFVKVSLMNHNKFVKCKKTSAVLGSINPVYNETFSFKADATKLDTASLSLTAVQNMEGDSKATPYPGLLGWGPRGAAECSGRVSASCPDLRRSCTSSLPG

SEQ ID NO: 856089 - protein, 136 aa, Homo sapiens; identical to SEQ ID NO: 856078

SEQ ID NO: 856090 - protein, 136 aa, Homo sapiens; identical to SEQ ID NO: 856078

SEQ ID NO: 856091 - protein, 136 aa, Homo sapiens; identical to SEQ ID NO: 856078

SEQ ID NO: 856092 - protein, 136 aa, Homo sapiens; identical to SEQ ID NO: 856078

SEQ ID NO: 856093 - protein, 869 aa, Homo sapiens
AAQRLPLPLPQPRPAPTRGSEPEPSLRLGEDHAAVAAMLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 856094 - protein, 768 aa, Homo sapiens
AAQRLPLPLPQPRPAPTRGSEPEPSLRLGEDHAAVAAMLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFKDKVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 856095 - protein, 869 aa, Homo sapiens; identical to SEQ ID NO: 856093

SEQ ID NO: 856096 - protein, 869 aa, Homo sapiens; identical to SEQ ID NO: 856093

SEQ ID NO: 856097 - protein, 847 aa, Homo sapiens
AAQRLPLPLPQPRPAPTRGSEPEPSLRLGEDHAAVAAMLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPP

SEQ ID NO: 856098 - protein, 595 aa, Homo sapiens
AAQRLPLPLPQPRPAPTRGSEPEPSLRLGEDHAAVAAMLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFE

SEQ ID NO: 856099 - protein, 183 aa, Homo sapiens
MYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 856100 - protein, 134 aa, Homo sapiens
IHPGSLVICPHCPLPTPTLLGHEGDGGKAQLTAPPSAQEDHAAVAAMLPFLLATLGTTALNNSNPKDYCYSARIRSTVLQGLPFGGVPTVLALDFMCFLVSACCHPLPWHPCPVHTWQTLPALTTLPPAPVSQA

SEQ ID NO: 856101 - protein, 871 aa, Homo sapiens
PKEKTWTQLRVPSLQPPAGPRGARARGTQGWRALPPTPHHPEPNEDHAAVAAMLPFLLATLGTTALNNSNPKDYCYSARIRSTVLQGLPFGGVPTVLALDFMCFLALLFLFSILRKVAWDYGRLALVTDADSVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 856102 - protein, 1201 aa, Homo sapiens
AAQRLPLPLPQPRPAPTRGSEPEPSLRLGEDHAAVAAMLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRPMGEVQQSFQLLEGAEERGSGGVTPKAPTRCLGCVYMVEVPGVCVGVHSLVTCLDAKITLKVYLGLGAPHSGSFYGGVLCPYSGTNCGRLWSSTWEVWGTISREVLVILRECLGGYYGVSLKVSRAHIFGYVYEALDLITLGVSVGGEAKGLTLWDDLAVQVLGTSLKFQAFIQRCNCGVLYGHLLWESCEDILKVMHHGCGHKLYGFCCRPSVVIFEITLGASQALIKVPGLPQRCCGKGLKACLWRYLRLMSHSGGNSSYGLSGGIFWVFLGLSAFGFFEGLIGLSLGVLDSSPLNILAALGGLEHSLHGSLWGTVLGAVCCHSVCLWGEQGTGAWGAKLGVSTWKKHVGGGGVGCCSSGSGRAATGSPQGCSAGAPGARRCVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 856103 - protein, 472 aa, Homo sapiens
MAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 856104 - protein, 869 aa, Homo sapiens; identical to SEQ ID NO: 856093

SEQ ID NO: 856105 - protein, 347 aa, Homo sapiens
MGLYGAQVLGAVCCHSVCLWGEQGTGAWGAKLGVSTWKKHVGGGGVGCCSSGSGRAATGSPQGCSAGAPGARRCVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 856106 - protein, 298 aa, Homo sapiens
AAQRLPLPLPQPRPAPTRGSEPEPSLRLGEDHAAVAAMLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFE

SEQ ID NO: 856107 - protein, 122 aa, Homo sapiens
GVGMLERHCQPHGRVQQSFQLLEGAEERGSGGVTPKAPTRCLGCVYMVEVPGVCVGVHSLVTCLDAKITLKVYLGLGAPHSGSFYGGVLCPYSGTNCGRLWSSTWEVWGTISREVLVILREC

SEQ ID NO: 856108 - protein, 167 aa, Homo sapiens
TLAVFVPTLAGFSVALGGPAWGRRRRSVSGVGVWLQWQCFLFCSRGPAQAGGQPALAATSVAMGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKENVVFCKMKR

SEQ ID NO: 856109 - protein, 1524 aa, Homo sapiens
TLAVFVPTLAGFSVALGGPAWGRRRRSVSGVGVWLQWQCFLFCSRGPAQAGGQPALAATSVAMGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKDENFILKHDRAFLLSMANRGKHTNGSQFFITTKPAPHLDGVHVVFGLVISGFEVIEQIENLKTDAASRPYADVRVIDCGVLATKSIKDVFEKKRKKPTHSEGSDSSSNSSSSSESSSESELEHERSRRRKHKRRPKVKRSKKRRKEASSSEEPRNKHAMNPKGHSERSDTNEKRSVDSSAKREKPVVRPEEIPPVPENRFLLRRDMPVVTAEPEPKIPDVAPIVSDQKPSVSKSGRKIKGRGTIRYHTPPRSRSCSESDDDDSSETPPHWKEEMQRLRAYRPPSGEKWSKGDKLSDPCSSRWDERSLSQRSRSWSYNGYYSDLSTARHSGHHKKRRKEKKVKHKKKGKKQKHCRRHKQTKKRRILIPSDIESSKSSTRRMKSSCDRERSSRSSSLSSHHSSKRDWSKSDKDVQSSLTHSSRDSYRSKSHSQSYSRGSSRSRTASKSSSHSRSRSKSRSSSKSGHRKRASKSPRKTASQLSENKPVKTEPLRATMAQNENVVVQPVVAENIPVIPLSDSPPPSRWKPGQKPWKPSYERIQEMKAKTTHLLPIQSTYSLANIKETGSSSSYHKREKNSESDQSTYSKYSDRSSESSPRSRSRSSRSRSYSRSYTRSRSLASSHSRSRSPSSRSHSRNKYSDHSQCSRSSSYTSISSDDGRRAKRRLRSSGKKNSVSHKKHSSSSEKTLHSKYVKGRDRSSCVRKYSESRSSLDYSSDSEQSSVQATQSAQEKEKQGQMERTHNKQEKNRGEEKSKSERECPHSKKRTLKENLSDHLRNGSKPKRKNYAGSKWDSESNSERDVTKNSKNDSHPSSDKEEGEATSDSESEVSEIHIKVKPTTKSSTNTSLPDDNGAWKSSKQRTSTSDSEGSCSNSENNRGKPQKHKHGSKENLKREHTKKVKEKLKGKKDKKHKAPKRKQAFHWQPPLEFGEEEEEEIDDKQVTQESKEKKVSENNETIKDNILKTEKSSEEDLSGKHDTVTVSSDLDQFTKDDSKLSISPTALNTEENVACLQNIQHVEESVPNGVEDVLQTDDNMEICTPDRSSPAKVEETSPLGNARLDTPDINIVLKQDMATEHPQAEVVKQESSMSESKVLGEVGKQDSSSASLASAGESTGKKEVAEKSQINLIDKKWKPLQGVGNLAAPNAATSSAVEVKVLTTVPEMKPQGLRIEIKSKNKVRPGSLFDEVRKTARLNRRPRNQESSSDEQTPSRDDDSQSRSPSRSRSKSETKSRHRTRSVSYSHSRSRSRSSTSSYRSRSYSRSRSRGWYSRGRTRSRSSSYRSYKSHRTSSRSRSRSSSYDPHSRSRSYTYDSYYSRSRSRSRSQRSDSYHRGRSYNRRSRSCRSYGSDSESDRSYSHHRSPSESSRYS

SEQ ID NO: 856110 - protein, 1209 aa, Homo sapiens
MNPKGHSERSDTNEKRSVDSSAKREKPVVRPEEIPPVPENRFLLRRDMPVVTAEPEPKIPDVAPIVSDQKPSVSKSGRKIKGRGTIRYHTPPRSRSCSESDDDDSSETPPHWKEEMQRLRAYRPPSGEKWSKGDKLSDPCSSRWDERSLSQRSRSWSYNGYYSDLSTARHSGHHKKRRKEKKVKHKKKGKKQKHCRRHKQTKKRRILIPSDIESSKSSTRRMKSSCDRERSSRSSSLSSHHSSKRDWSKSDKDVQSSLTHSSRDSYRSKSHSQSYSRGSSRSRTASKSSSHSRSRSKSRSSSKSGHRKRASKSPRKTASQLSENKPVKTEPLRATMAQNENVVVQPVVAENIPVIPLSDSPPPSRWKPGQKPWKPSYERIQEMKAKTTHLLPIQSTYSLANIKETGSSSSYHKREKNSESDQSTYSKYSDRSSESSPRSRSRSSRSRSYSRSYTRSRSLASSHSRSRSPSSRSHSRNKYSDHSQCSRSSSYTSISSDDGRRAKRRLRSSGKKNSVSHKKHSSSSEKTLHSKYVKGRDRSSCVRKYSESRSSLDYSSDSEQSSVQATQSAQEKEKQGQMERTHNKQEKNRGEEKSKSERECPHSKKRTLKENLSDHLRNGSKPKRKNYAGSKWDSESNSERDVTKNSKNDSHPSSDKEEGEATSDSESEVSEIHIKVKPTTKSSTNTSLPDDNGAWKSSKQRTSTSDSEGSCSNSENNRGKPQKHKHGSKENLKREHTKKVKEKLKGKKDKKHKAPKRKQAFHWQPPLEFGEEEEEEIDDKQVTQESKEKKVSENNETIKDNILKTEKSSEEDLSGKHDTVTVSSDLDQFTKDDSKLSISPTALNTEENVACLQNIQHVEESVPNGVEDVLQTDDNMEICTPDRSSPAKVEETSPLGNARLDTPDINIVLKQDMATEHPQAEVVKQESSMSESKVLGEVGKQDSSSASLASAGESTGKKEVAEKSQINLIDKKWKPLQGVGNLAAPNAATSSAVEVKVLTTVPEMKPQGLRIEIKSKNKVRPGSLFDEVRKTARLNRRPRNQESSSDEQTPSRDDDSQSRSPSRSRSKSETKSRHRTRSVSYSHSRSRSRSSTSSYRSRSYSRSRSRGWYSRGRTRSRSSSYRSYKSHRTSSRSRSRSSSYDPHSRSRSYTYDSYYSRSRSRSRSQRSDSYHRGRSYNRRSRSCRSYGSDSESDRSYSHHRSPSESSRYS

SEQ ID NO: 856111 - protein, 979 aa, Homo sapiens
MNPKGHSERSDTNEKRSVDSSAKREKPVVRPEEIPPVPENRFLLRRDMPVVTAEPEPKIPDVAPIVSDQKPSVSKSGRKIKGRGTIRYHTPPRSRSCSESDDDDSSETPPHWKEEMQRLRAYRPPSGEKWSKGDKLSDPCSSRWDERSLSQRSRSWSYNGYYSDLSTARHSGHHKKRRKEKKVKHKKKGKKQKHCRRHKQTKKRRILIPSDIESSKSSTRRMKSSCDRERSSRSSSLSSHHSSKRDWSKSDKDVQSSLTHSSRDSYRSKSHSQSYSRGSSRSRTASKSSSHSRSRSKSRSSSKSGHRKRASKSPRKTASQLSENKPVKTEPLRATMAQNENVVVQPVVAENIPVIPLSDSPPPSRWKPGQKPWKPSYERIQEMKAKTTHLLPIQSTYSLANIKETGSSSSYHKREKNSESDQSTYSKYSDRSSESSPRSRSRSSRSRSYSRSYTRSRSLASSHSRSRSPSSRSHSRNKYSDHSQCSRSSSYTSISSDDGRRAKRRLRSSGKKNSVSHKKHSSSSEKTLHSKYVKGRDRSSCVRKYSESRSSLDYSSDSEQSSVQATQSAQEKEKQGQMERTHNKQEKNRGEEKSKSERECPHSKKRTLKENLSDHLRNGSKPKRKNYAGSKWDSESNSERDVTKNSKNDSHPSSDKEEGEATSDSESEVSEIHIKVKPTTKSSTNTSLPDDNGAWKSSKQRTSTSDSEGSCSNSENNRGKPQKHKHGSKENLKREHTKKVKEKLKGKKDKKHKAPKRKQAFHWQPPLEFGEEEEEEIDDKQVTQESKEKKVSENNETIKDNILKTEKSSEEDLSGKHDTVTVSSDLDQFTKDDSKLSISPTALNTEENVACLQNIQHVEESVPNGVEDVLQTDDNMEICTPDRSSPAKVEETSPLGNARLDTPDINIVLKQDMATEHPQAEVRTAALLAWLVLEKVPGRRRWLRRARSTSLIRNGSPCKVWGTWQHLMLPHPVLWKLRC

SEQ ID NO: 856112 - protein, 1209 aa, Homo sapiens; identical to SEQ ID NO: 856110

SEQ ID NO: 856113 - protein, 1352 aa, Homo sapiens [sequence omitted]

SEQ ID NO: 856114 - protein, 1352 aa, Homo sapiens [sequence omitted]

SEQ ID NO: 856115 - protein, 1209 aa, Homo sapiens; identical to SEQ ID NO: 856110

SEQ ID NO: 856116 - protein, 1209 aa, Homo sapiens; identical to SEQ ID NO: 856110

SEQ ID NO: 856117 - protein, 1162 aa, Homo sapiens [sequence omitted]

SEQ ID NO: 856118 - protein, 988 aa, Homo sapiens [sequence omitted]

SEQ ID NO: 856119 - protein, 1209 aa, Homo sapiens; identical to SEQ ID NO: 856110

SEQ ID NO: 856120 - protein, 202 aa, Homo sapiens
SEIGRSRKQQKQEAAEAGSKQKQEAGRSRKQAEAGSKASPGVQVDLEVNLKPNQDTEQGLSPIVTQEVDREVPHHLIDQEATLEVGAEDGTAEAEPEAGAVPTGVTKVTGRPAGADPGAAHMIPTVDPGPTPTIATIAGVGVEVEAREVTVTTEAEVIIGGPGVVDLMALTVKVTEVTLITGAPVRAADTVENVRIQIISYL

SEQ ID NO: 856121 - protein, 1209 aa, Homo sapiens; identical to SEQ ID NO: 856110

SEQ ID NO: 856122 - protein, 1209 aa, Homo sapiens; identical to SEQ ID NO: 856110

SEQ ID NO: 856123 - protein, 1209 aa, Homo sapiens; identical to SEQ ID NO: 856110

SEQ ID NO: 856124 - protein, 1076 aa, Homo sapiens
MNPKGHSERSDTNEKRSVDSSAKREKPVVRPEEIPPVPENRFLLRRDMPVVTAEPEPKIPDVAPIVSDQKPSVSKSGRKIKGRGTIRYHTPPRSRSCSESDDDDSSETPPHWKEEMQRLRAYRPPSGEKWSKGDKLSDPCSSRWDERSLSQRSRSWSYNGYYSDLSTARHSGHHKKRRKEKKVKHKKKGKKQKHCRRHKQTKKRRILIPSDIESSKSSTRRMKSSCDRERSSRSSSLSSHHSSKRDWSKSDKDVQSSLTHSSRDSYRSKSHSQSYSRGSSRSRTASKSSSHSRSRSKSRSSSKSGHRKRASKSPRKTASQLSENKPVKTEPLRATMAQNENVVVQPVVAENIPVIPLSDSPPPSRWKPGQKPWKPSYERIQEMKAKTTHLLPIQSTYSLANIKETGSSSSYHKREKNSESDQSTYSKYSDRSSESSPRSRSRSSRSRSYSRSYTRSRSLASSHSRSRSPSSRSHSRNKYSDHSQCSRSSSYTSISSDDGRRAKRRLRSSGKKNSVSHKKHSSSSEKTLHSKYVKGRDRSSCVRKYSESRSSLDYSSDSEQSSVQATQSAQEKEKQGQMERTHNKQEKNRGEEKSKSERECPHSKKRTLKENLSDHLRNGSKPKRKNYAGSKWDSESNSERDVTKNSKNDSHPSSDKEEGEATSDSESEVSEIHIKVKPTTKSSTNTSLPDDNGAWKSSKQRTSTSDSEGSCSNSENNRGKPQKHKHGSKENLKREHTKKVKEKLKGKKDKKHKAPKRKQAFHWQPPLEFGEEEEEEIDDKQVTQESKEKKVSENNETIKDNILKTEKSSEEDLSGKHDTVTVSSDLDQFTKDDSKLSISPTALNTEENVACLQNIQHVEESVPNGVEDVLQTDDNMEICTPDRSSPAKVEETSPLGNARLDTPDINIVLKQDMATEHPQAEVVKQESSMSESKVLGEVGKQDSSSASLASAGESTGKKEVAEKSQINLIDKKWKPLQGVGNLAAPNAATSSAVEVKVLTTVPEMKPQGLRIEIKSKNKVRPGSSQPPPSSRYFLQHYPSLQSSGPVSPLTHTLLFDICFPVYYLCLRCSVHIPHNS

SEQ ID NO: 856125 - protein, 160 aa, Homo sapiens
TLAVFVPTLAGFSVALGGPAWGRRRRSVSGVGVWLQWQCFLFCSRGPAQAGGQPALAATSVAMGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKGKA

SEQ ID NO: 856126 - protein, 1524 aa, Homo sapiens; identical to SEQ ID NO: 856109

SEQ ID NO: 856127 - protein, 1524 aa, Homo sapiens; identical to SEQ ID NO: 856109

SEQ ID NO: 856128 - protein, 1209 aa, Homo sapiens; identical to SEQ ID NO: 856110

SEQ ID NO: 856129 - protein, 1352 aa, Homo sapiens [sequence omitted]

SEQ ID NO: 856130 - protein, 1209 aa, Homo sapiens; identical to SEQ ID NO: 856110

SEQ ID NO: 856131 - protein, 1209 aa, Homo sapiens; identical to SEQ ID NO: 856110

SEQ ID NO: 856132 - protein, 1209 aa, Homo sapiens; identical to SEQ ID NO: 856110

SEQ ID NO: 856133 - protein, 1209 aa, Homo sapiens; identical to SEQ ID NO: 856110

SEQ ID NO: 856134 - protein, 794 aa, Homo sapiens
CYPWDPEGRRGPGVPRGLGHPGKSRSRSSRSRSYSRSYTRSRSLASSHSRSRSPSSRSHSRNKYSDHSQCSRSSSYTSISSDDGRRAKRRLRSSGKKNSVSHKKHSSSSEKTLHSKYVKGRDRSSCVRKYSESRSSLDYSSDSEQSSVQATQSAQEKEKQGQMERTHNKQEKNRGEEKSKSERECPHSKKRTLKENLSDHLRNGSKPKRKNYAGSKWDSESNSERDVTKNSKNDSHPSSDKEEGEATSDSESEVSEIHIKVKPTTKSSTNTSLPDDNGAWKSSKQRTSTSDSEGSCSNSENNRGKPQKHKHGSKENLKREHTKKVKEKLKGKKDKKHKAPKRKQAFHWQPPLEFGEEEEEEIDDKQVTQESKEKKVSENNETIKDNILKTEKSSEEDLSGKHDTVTVSSDLDQFTKDDSKLSISPTALNTEENVACLQNIQHVEESVPNGVEDVLQTDDNMEICTPDRSSPAKVEETSPLGNARLDTPDINIVLKQDMATEHPQAEVVKQESSMSESKVLGEVGKQDSSSASLASAGESTGKKEVAEKSQINLIDKKWKPLQGVGNLAAPNAATSSAVEVKVLTTVPEMKPQGLRIEIKSKNKVRPGSLFDEVRKTARLNRRPRNQESSSDEQTPSRDDDSQSRSPSRSRSKSETKSRHRTRSVSYSHSRSRSRSSTSSYRSRSYSRSRSRGWYSRGRTRSRSSSYRSYKSHRTSSRSRSRSSSYDPHSRSRSYTYDSYYSRSRSRSRSQRSDSYHRGRSYNRRSRSCRSYGSDSESDRSYSHHRSPSESSRYS

SEQ ID NO: 856135 - protein, 632 aa, Homo sapiens [sequence omitted]

SEQ ID NO: 856136 - protein, 160 aa, Homo sapiens; identical to SEQ ID NO: 856125

SEQ ID NO: 856137 - protein, 1209 aa, Homo sapiens; identical to SEQ ID NO: 856110

SEQ ID NO: 856138 - protein, 1209 aa, Homo sapiens; identical to SEQ ID NO: 856110

SEQ ID NO: 856139 - protein, 1209 aa, Homo sapiens; identical to SEQ ID NO: 856110

SEQ ID NO: 856140 - protein, 1209 aa, Homo sapiens; identical to SEQ ID NO: 856110

SEQ ID NO: 856141 - protein, 108 aa, Homo sapiens
TLAVFVPTLAGFSVALGGPAWGRRRRSVSGVGVWLQWQCFLFCSRGPAQAGGQPALAATSVAMGAQDRPQCHFDIEINREPVGRIMFQLFSDICPKTCKNFLCLCSGK

SEQ ID NO: 856142 - protein, 106 aa, Homo sapiens
TAALPPPRDARMAAASSYCRSSASERSTLLGAIACLSHVSGGSWKASFSFPSSPACPPCFQAGSGLVFPRKEMAGELQGGPRRRRFGGAWADQPGQRGKPEQFCAR

SEQ ID NO: 856143 - protein, 253 aa, Homo sapiens
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 856144 - protein, 219 aa, Homo sapiens
MASGSNWLSGVNVVLVMAYGSLDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 856145 - protein, 253 aa, Homo sapiens; identical to SEQ ID NO: 856143

SEQ ID NO: 856146 - protein, 322 aa, Homo sapiens
GALVCCHWWWYGRYSGIHVFRPGLAWSSPVRKWPGSSRGDPGAVASAEPGLTSQDSGVNPNNSARGREAMASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 856147 - protein, 218 aa, Homo sapiens
MRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 856148 - protein, 235 aa, Homo sapiens
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQKIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 856149 - protein, 150 aa, Homo sapiens
MKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 856150 - protein, 201 aa, Homo sapiens
MASGSNWLSGVNVVLVMAYGSLDLKEEIDIRLSRVQDIKYEPQLLADDDARLLQLETQGNQKIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 856151 - protein, 150 aa, Homo sapiens; identical to SEQ ID NO: 856149

SEQ ID NO: 856152 - protein, 126 aa, Homo sapiens
MGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 856153 - protein, 201 aa, Homo sapiens; identical to SEQ ID NO: 856150

SEQ ID NO: 856154 - protein, 210 aa, Homo sapiens
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYYQEALSELATAVKARIGSSQRHHQSAAKDLTQSPEVSPTTIQVTYLPSSQKSKRAKHFLELKSFKDNYNTLESTL

SEQ ID NO: 856155 - protein, 106 aa, Homo sapiens; identical to SEQ ID NO: 856142

SEQ ID NO: 856156 - protein, 230 aa, Homo sapiens
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVSLEGNVSEGAGTVVLDCCHSAVTFIKHINKIHDTIRVVRF

SEQ ID NO: 856157 - protein, 196 aa, Homo sapiens
MASGSNWLSGVNVVLVMAYGSLDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVSLEGNVSEGAGTVVLDCCHSAVTFIKHINKIHDTIRVVRF

SEQ ID NO: 856158 - protein, 150 aa, Homo sapiens; identical to SEQ ID NO: 856149

SEQ ID NO: 856159 - protein, 103 aa, Homo sapiens
MGKNFRSYLLDLRNTSTPFKGVRKALIDTLLDGYETARYGTGVFGQNEYLRYQEALSELATAVSLEGNVSEGAGTVVLDCCHSAVTFIKHINKIHDTIRVVRF

SEQ ID NO: 856160 - protein, 219 aa, Homo sapiens; identical to SEQ ID NO: 856144

SEQ ID NO: 856161 - protein, 253 aa, Homo sapiens; identical to SEQ ID NO: 856143

SEQ ID NO: 856162 - protein, 253 aa, Homo sapiens; identical to SEQ ID NO: 856143

SEQ ID NO: 856163 - protein, 253 aa, Homo sapiens; identical to SEQ ID NO: 856143

SEQ ID NO: 856164 - protein, 150 aa, Homo sapiens; identical to SEQ ID NO: 856149

SEQ ID NO: 856165 - protein, 253 aa, Homo sapiens; identical to SEQ ID NO: 856143

SEQ ID NO: 856166 - protein, 150 aa, Homo sapiens; identical to SEQ ID NO: 856149

SEQ ID NO: 856167 - protein, 126 aa, Homo sapiens; identical to SEQ ID NO: 856152

SEQ ID NO: 856168 - protein, 190 aa, Homo sapiens
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRHPGDIPPLQSEE

SEQ ID NO: 856169 - protein, 243 aa, Homo sapiens
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTTSGGYSLGRNKGPVLMGAWDLTGDR

SEQ ID NO: 856170 - protein, 230 aa, Homo sapiens; identical to SEQ ID NO: 856156

SEQ ID NO: 856171 - protein, 238 aa, Homo sapiens
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQKIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTPDSPSGKRMQASDEVGPNLGLGGRCENLVEGWAHCERV

SEQ ID NO: 856172 - protein, 106 aa, Homo sapiens; identical to SEQ ID NO: 856142

SEQ ID NO: 856173 - protein, 538 aa, Homo sapiens
RGTYYPPYFWVGPSGKMAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEPGQGQGCR

SEQ ID NO: 856174 - protein, 259 aa, Homo sapiens
SAATEDAKMDARQPGERSQPHPRRYPRGPALSLLTPAIRGLRVLLRLPLELLGGGAHRRVPQQVLMLLAPQVLEVAVLQGLPRVLRERALLHRFPQGVTGDGAGRAGIFLHVGKDGYVVRIREGDPPGVPLRLRLRGALGQGPGLCFRAGVRRRGGAQPIGLQLQPLVALHAVQDVLRGDEITRGLGQRLPGLGQQHGPGLLHSAHGAAAVQDERRQPTLGRAGPHVEGHGAAVVPHEQSRGMGGPVGVFAQIHRLRHV

SEQ ID NO: 856175 - protein, 101 aa, Homo sapiens
GNRTCETFAKLVDPPPRTTARLLDKLVGEFLEVTCINPTFICDHPQIMSPLAKWHRSKEGLTERFELFVMKKEICNAYTELNDPMRQRQLFEETGQGQGCR

SEQ ID NO: 856176 - protein, 112 aa, Homo sapiens
RGTYYPPYFWVGPSGKMAAVQAAEVKVDGSEPKLSKNELKRRLKAEKKVAEKEAKQKELSEKQLSQATAAATNHTTDNGVGPEEESVDPNVGSMPKELLGESSSSMIFEERG

SEQ ID NO: 856177 - protein, 550 aa, Homo sapiens
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEPGQGQGCR

SEQ ID NO: 856178 - protein, 550 aa, Homo sapiens; identical to SEQ ID NO: 856177

SEQ ID NO: 856179 - protein, 564 aa, Homo sapiens
ALLPKMPRWTPGSQEKDPNPTRADIREAPRSASSPPLSAASGSSSAFRLSFWEEGLTGASPSSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEPGQGQGCR

SEQ ID NO: 856180 - protein, 449 aa, Homo sapiens
MQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEPGQGQGCR

SEQ ID NO: 856181 - protein, 366 aa, Homo sapiens
MANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEETGQGQGCR

SEQ ID NO: 856182 - protein, 421 aa, Homo sapiens
ITLGSLYDMTITTPSLAEDLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEETGQGQGCR

SEQ ID NO: 856183 - protein, 538 aa, Homo sapiens; identical to SEQ ID NO: 856173

SEQ ID NO: 856184 - protein, 538 aa, Homo sapiens; identical to SEQ ID NO: 856173

SEQ ID NO: 856185 - protein, 538 aa, Homo sapiens; identical to SEQ ID NO: 856173

SEQ ID NO: 856186 - protein, 526 aa, Homo sapiens
RGTYYPPYFWVGPSGKMAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELGTKLDSIM

SEQ ID NO: 856187 - protein, 515 aa, Homo sapiens
RGTYYPPYFWVGPSGKMAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPSNFGETPKQRAPKGSFDKLVGEFLGSDLHSIPFNNFPNFLGWENSKTPPKTKGAHLLTLWTRSP

SEQ ID NO: 856188 - protein, 101 aa, Homo sapiens; identical to SEQ ID NO: 856175

SEQ ID NO: 856189 - protein, 301 aa, Homo sapiens
RGTYYPPYFWVGPSGKMAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETSLMNIIPAGANKVGEKK

SEQ ID NO: 856190 - protein, 177 aa, Homo sapiens
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRNSPWQITELPQQVGLRLQ

SEQ ID NO: 856191 - protein, 252 aa, Homo sapiens
VSCLYVLPSFLVNCFFYVGFPSIVRNECSFWFPSRLVCSLPLELLGGGAHRRVPQQVLMLLAPQVLEVAVLQGLPRVLRERALLHRFPQGVTGDGAGRAGIFLHVGKDGYVVRIREGDPPGVPLRLRLRGALGQGPGLCFRAGVRRRGGAQPIGLQLQPLVALHAVQDVLRGDEITRGLGQRLPGLGQQHGPGLLHSAHGAAAVQDERRQPTLGRAGPHVEGHGAAVVPHEQSRGMGGPVGVFAQIHRLRHV

SEQ ID NO: 856192 - protein, 157 aa, Homo sapiens
RGTYYPPYFWVGPSGKMAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPRVAMFLTDSNNIKEVLLFPAMKPEDKKENVATTDTLESTTVGTSV

SEQ ID NO: 856193 - protein, 235 aa, Homo sapiens
LYCDSRRAVVKQTEILGARCGPRRAGGPQILRGTPPKPGTNWRFLPGSPQVRNRSNPVRIPPRSLPFRELERAHRRVPQQVLMLLAPQVLEVAVLQGLPRVLRERALLHRFPQGVTGDGAGRAGIFLHVGKDGYVVRIREGDPPGVPLRLRLRGALGQGPGLCFRAGVRRRGGAQPIGLQLQPLVALHAVQDVLRGDEITRGVEGHGAAVVPHEQSRGMGGPVGVFAQIHRLRHV

SEQ ID NO: 856194 - protein, 498 aa, Homo sapiens
RGTYYPPYFWVGPSGKMAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEPGQGQGCR

SEQ ID NO: 856195 - protein, 564 aa, Homo sapiens
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLCLPEQFVINMNNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEPGQGQGCR

SEQ ID NO: 856196 - protein, 532 aa, Homo sapiens
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPAPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEPGQGQGCR

SEQ ID NO: 856197 - protein, 520 aa, Homo sapiens
RGTYYPPYFWVGPSGKMAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPAPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEPGQGQGCR

SEQ ID NO: 856198 - protein, 538 aa, Homo sapiens; identical to SEQ ID NO: 856173

SEQ ID NO: 856199 - protein, 538 aa, Homo sapiens; identical to SEQ ID NO: 856173

SEQ ID NO: 856200 - protein, 499 aa, Homo sapiens
RGTYYPPYFWVGPSGKMAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWRSRSRAAA

SEQ ID NO: 856201 - protein, 422 aa, Homo sapiens
SGTYYPPYFWVGPSGKMAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGLDPGYELWPAVRDAGFVGANSWVSHPVSSMGYGISRSLGIPGNWPGGGSTLGGKGPTPLPGPLMFFPTSAGHGKHVTRGEPAHPYTDTSFFSVRT

SEQ ID NO: 856202 - protein, 284 aa, Homo sapiens
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKSSRHVSHGLQQHQGSTSVSCHETRRQEGECSNH

SEQ ID NO: 856203 - protein, 211 aa, Homo sapiens
VSCLYVLPSFLVNCFFYVGFPSIVRNECSFWFPSRLVCSLPLELLGGGAHRRVPQQVLMLLAPQVLEVAVLQGLPRVLRERALLHRFPQGVTGDGAGRAGIFLHVGKDGYVVRIREGDPPGVPLRLRLRGALGQGPGLCFRAGVRRRGGAQPIGLQLQPLVALHAVQDVLRGDEITRGVEGHGAAVVPHEQSRGMGGPVGVFAQIHRLRHV

SEQ ID NO: 856204 - protein, 421 aa, Homo sapiens
MPFLHGFRRIIFEYQPLVDAILGSLGIQDPERQESLDRPSYVASEESRILVLTELLERKAHSPFYQEGVSNALLKMAELGLTRAADVLLRHGANLNFEDPVTYYTALHIAVLRNQPDMVELLVHHGADVNRRDRIHESSPLDLASEEPERLPCLQRLLDLGADVNAADKHGKTALLHALASSDGVQIHNTENIRLLLEGGADVKATTKDGDTVFTCIIFLLGETVGGDKEEAQMINRFCFQVTRLLLAHGADPSECPAHESLTHICLKSFKLHFPLLRFLLESGAAYNCSLHGASCWSGFHIIFERLCSHPGCTEDESHADLLRKAETVLDLMVTNSQKLQLPENFDIHPVGSLAEKIQALHFSLRQLESYPPPLKHLCRVAIRLYLQPWPVDVKVKALPLPDRLKWYLLSEHSGSVEDDI

SEQ ID NO: 856205 - protein, 385 aa, Homo sapiens
MPFLHGFRRIIFEYQPLVDAILGSLGIQDPERQESLDRPSYVASEESRILVLTELLERKAHSPFYQEGVSNALLKMAELGLTRAADVLLRHGANLNFEDPVTYYTALHIAVLRNQPDMVELLVHHGADVNRRDREKLLCSMLWPAATGCRSTILRTFVSYWKEGQTSRPPPKMGTQCSPASSSCLVRPWEGTEEEAQMINRFCFQVTRLLLAHGADPSECPAHESLTHICLKSFKLHFPLLRFLLESGAAYNCSLHGASCWSGFHIIFERLCSHPGCTEDESHADLLRKAETVLDLMVTNSQKLQLPENFDIHPVGSLAEKIQALHFSLRQLESYPPPLKHLCRVAIRLYLQPWPVDVKVKALPLPDRLKWYLLSEHSGSVEDDI

SEQ ID NO: 856206 - protein, 439 aa, Homo sapiens
GFMDLDESATDPLRGPAETPILHRYEGSRSFTIRWCKPYSKKVGIQDPERQESLDRPSYVASEESRILVLTELLERKAHSPFYQEGVSNALLKMAELGLTRAADVLLRHGANLNFEDPVTYYTALHIAVLRNQPDMVELLVHHGADVNRRDRIHESSPLDLASEEPERLPCLQRLLDLGADVNAADKHGKTALLHALASSDGVQIHNTENIRLLLEGGADVKATTKDGDTVFTCIIFLLGETVGGDKEEAQMINRFCFQVTRLLLAHGADPSECPAHESLTHICLKSFKLHFPLLRFLLESGAAYNCSLHGASCWSGFHIIFERLCSHPGCTEDESHADLLRKAETVLDLMVTNSQKLQLPENFDIHPVGSLAEKIQALHFSLRQLESYPPPLKHLCRVAIRLYLQPWPVDVKVKALPLPDRLKWYLLSEHSGSVEDDI

SEQ ID NO: 856207 - protein, 421 aa, Homo sapiens; identical to SEQ ID NO: 856204

SEQ ID NO: 856208 - protein, 189 aa, Homo sapiens
SVPVGVWASRPRQKARPPCCAGPAAMPFLHGFRRIIFEYQPLVDAILGSLGIQDPERQESLDRYSPPPVSWPRPLRPRSVPLYHHKPGGVDASPLTEEGTGGSRGCVARSARCPARIPLLPLAWRRRRAGRARGRRPAGCRRACASAPPCRLPVLCHPPAWQRSRVESVRPQMLPQSSVKVGFCSRVCV

SEQ ID NO: 856209 - protein, 1093 aa, Homo sapiens
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGAGSSIIENLQSQLKLREGEITHLQLEIGNLEKTRSIMAEELVKLTNQNDELEEKVKEIPKLRTQLRDLDQRYNTILQMYGEKAEEAEELRLDLEDVKNMYKTQIDELLRQSLS

SEQ ID NO: 856210 - protein, 1093 aa, Homo sapiens; identical to SEQ ID NO: 856209

SEQ ID NO: 856211 - protein, 197 aa, Homo sapiens [sequence omitted]

SEQ ID NO: 856212 - protein, 1012 aa, Homo sapiens
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGAGSSIIENLQSQLKLREGEITHLQVLEKLNLL

SEQ ID NO: 856213 - protein, 1012 aa, Homo sapiens; identical to SEQ ID NO: 856212

SEQ ID NO: 856214 - protein, 458 aa, Homo sapiens
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKVTLVSGRDF

SEQ ID NO: 856215 - protein, 1093 aa, Homo sapiens; identical to SEQ ID NO: 856209

SEQ ID NO: 856216 - protein, 1101 aa, Homo sapiens
FQGAADEAGEALEMSVEEAKRKISSLSFTLEEEEEGGVEEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGAGSSIIENLQSQLKLREGEITHLQLEIGNLEKTRSIMAEELVKLTNQNDELEEKVKEIPKLRTQLRDLDQRYNTILQMYGEKAEEAEELRLDLEDVKNMYKTQIDELLRQSLS

SEQ ID NO: 856217 - protein, 1012 aa, Homo sapiens; identical to SEQ ID NO: 856212

SEQ ID NO: 856218 - protein, 1004 aa, Homo sapiens
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGAGSSIIENLQSQLKLREGEITHLQ

SEQ ID NO: 856219 - protein, 74 aa, Homo sapiens
KKISNGFTGKICQIFKKQVISILDRIFQRRENGKRVVPHFMKLVYTSVPTFDKGSLKKENHRLISPMSRDLKNS

SEQ ID NO: 856220 - protein, 94 aa, Homo sapiens
CGRTRGSPPGPSLQVQLFIEILNRYIYFYEKENDAVTIQVLNQLIQKIREDLPNLESSEETEQINKHFHNTLEHLRLRRESPESEGPIYEGLIL

SEQ ID NO: 856221 - protein, 796 aa, Homo sapiens
MPTTQQSPQDEQEKLLDEAIQAVKVQSFQMKRCLDKNKLMDALKHASNMLGELRTSMLSPKSYYELYMAISDELHYLEVYLTDEFAKGRKVADLYELVQYAGNIIPRLYLLITVGVVYVKSFPQSRKDILKDLVEMCRGVQHPLRGLFLRNYLLQCTRNILPDEGEPTDEETTGDISDSMDFVLLNFAEMNKLWVRMQHQGHSRDREKRERERQELRILVGTNLVRLSQLEGVNVERYKQIVLTGILEQVVNCRDALAQEYLMECIIQVFPDEFHLQTLNPFLRACAELHQNVNVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNGEELHGGKRVMECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 856222 - protein, 796 aa, Homo sapiens; identical to SEQ ID NO: 856221

SEQ ID NO: 856223 - protein, 776 aa, Homo sapiens
MPTTQQSPQDEQEKLLDEAIQAVKVQSFQMKRCLTKLMDALSYYELYMAISDELHYLEVYLTDEFAKGRKVADLYELVQYAGNIIPRLYLLITVGVVYVKSFPQSRKDILKDLVEMCRGVQHPLRGLFLRNYLLQCTRNILPDEGEPTDEETTGDISDSMDFVLLNFAEMNKLWVRMQHQGHSRDREKRERERQELRILVGTNLVRLSQLEGVNVERYKQIVLTGILEQVVNCRDALAQEYLMECIIQVFPDEFHLQTLNPFLRACAELHQNVNVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNGEELHGGKRVMECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 856224 - protein, 534 aa, Homo sapiens
MECIIQVFPDEFHLQTLNPFLRACAELHQNVNVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNGEELHGGKRVMECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 856225 - protein, 534 aa, Homo sapiens; identical to SEQ ID NO: 856224

SEQ ID NO: 856226 - protein, 796 aa, Homo sapiens; identical to SEQ ID NO: 856221

SEQ ID NO: 856227 - protein, 305 aa, Homo sapiens
MINQSLEIFFSLMLLGQILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNGEELHGGKRVMECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 856228 - protein, 559 aa, Homo sapiens
MPTTQQSPQDEQEKLLDEAIQAVKVQSFQMKRCLDKNKLMDALKHASNMLGELRTSMLSPKSYYELYMAISDELHYLEVYLTDEFAKGRKVADLYELVQYAGNIIPRLYLLITVGVVYVKSFPQSRKDILKDLVEMCRGVQHPLRGLFLRNYLLQCTRNILPDEGEPTDEETTGDISDSMDFVLLNFAEMNKLWVRMQHQGHSRDREKRERERQELRILVGTNLVRLSQLEGVNVERYKQIVLTGILEQVVNCRDALAQEYLMECIIQVFPDEFHLQTLNPFLRACAELHQNVNVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDSISGGDPLG

SEQ ID NO: 856229 - protein, 140 aa, Homo sapiens
MQFVFLPVPDRDVHRCSQLGPVSGRNTDKNGEELHGGKRVMECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 856230 - protein, 796 aa, Homo sapiens; identical to SEQ ID NO: 856221

SEQ ID NO: 856231 - protein, 796 aa, Homo sapiens; identical to SEQ ID NO: 856221

SEQ ID NO: 856232 - protein, 767 aa, Homo sapiens
MKRCLDKNKLMDALKHASNMLGELRTSMLSPKSYYELYMAISDELHYLEVYLTDEFAKGRKVADLYELVQYAGNIIPRLYLLITVGVVYVKSFPQSRKDILKDLVEMCRGVQHPLRGLFLRNYLLQCTRNILPDEGEPTDEETTGDISDSMDFVLLNFAEMNKLWVRMQHQGHSRDREKRERERQELRILVGTNLVRLSQLEGVNVERYKQIVLTGILEQVVNCRDALAQEYLMECIIQVFPDEFHLQTLNPFLRACAELHQNVNVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNGEELHGGKRVMECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 856233 - protein, 534 aa, Homo sapiens; identical to SEQ ID NO: 856224

SEQ ID NO: 856234 - protein, 519 aa, Homo sapiens
ELHQNDYVLHIYILVYTVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNGEELHGGKRVMECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 856235 - protein, 517 aa, Homo sapiens
MPTTQQSPQDEQEKLLDEAIQAVKVQSFQMKRCLDKNKLMDALKHASNMLGELRTSMLSPKSYYELYMAISDELHYLEVYLTDEFAKGRKVADLYELVQYAGNIIPRLIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNGEELHGGKRVMECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 856236 - protein, 571 aa, Homo sapiens
MPTTQQSPQDEQEKLLDEAIQAVKVQSFQMKRCLDKNKLMDALKHASNMLGELRTSMLSPKSYYELYMAISDELHYLEVYLTDEFAKGRKVADLYELVQYAGNIIPRLYLLITVGVVYVKSFPQSRKDILKDLVEMCRGVQHPLRGLFLRNYLLQCTRNILPDEGEPTDEETTGDISDSMDFVLLNFAEMNKLWVRMQHQGHSRDREKRERERQELRILVGTNLVRLSQLEGVNVERYKQIVLTGILEQVVNCRDALAQEYLMECIIQVFPDEFHLQTLNPFLRACAELHQNVNVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDSIWGFHLGIPFGDSIWGDSIW

SEQ ID NO: 856237 - protein, 462 aa, Homo sapiens
MPTTQQSPQDEQEKLLDEAIQAVKVQSFQMKRCLDKNKLMDALKHASNMLGELRTSMLSPKSYYELYMAISDELHYLEVYLTDEFAKGRKVADLYELVQYAGNIIPRLYLLITVGVVYVKSFPQSRKDILKDLVEMCRGVQHPLRGLFLRNYLLQCTRNILPDEGEPTDEETTGDISDSMDFVLLNFAEMNKLWVRMQHQGHSRDREKRERERQELRILVGTNLVRLSQLEGVNVERYKQIVLTGILEQVVNCRDALAQEYLMECIIQVFPDEFHLQTLNPFLRACAELHQNVNVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVREYLR

SEQ ID NO: 856238 - protein, 99 aa, Homo sapiens
LLLSPLPQEGPGSLAAGESSSLSASTSVSDSSQKKEEHNYSLFVSDNLGEQPTKCSPEEDEEDEEDVDDEDHDEGFGSEHYIIIKWYFLKLLGDSETPS

SEQ ID NO: 856239 - protein, 308 aa, Homo sapiens
MDPPFGDAFRSHTFSEQTLMSTDLLANSSDPDFMYELHDEGFGSEHELSENEEEEEEEEDYEDDKDDDISDTFSEPGYENDSVEDLKEVTSISSRKRGKRRYFWEYSEQLTPSQQERMLRPSEWNRDTLPSNMYQKNGLHHGKYAVKKSRRTDVEDLTPNPKKLLQIGNELRKLNKVISDLTPVSELPLTARPRSRKEKNKLASRACRLKKKAQYEANKVKLWGLNTEYDNLLFVINSIKQEIVNRVQNPRDERGPNMGQKLEILIKDTLGLPVAGQTSEFVNQVLEKTAEGNPTGGLVGLRIPTSKV

SEQ ID NO: 856240 - protein, 342 aa, Homo sapiens
LLLSPLPQEGPGSLAAGESSSLSASTSVSDSSQKKEEHNYSLFVSDNLGEQPTKCSPEEDEEDEEDVDDEDHDEGFGSEHELSENEEEEEEEEDYEDDKDDDISDTFSEPGYENDSVEDLKEVTSISSRKRGKRRYFWEYSEQLTPSQQERMLRPSEWNRDTLPSNMYQKNGLHHGKYAVKKSRRTDVEDLTPNPKKLLQIGNELRKLNKVISDLTPVSELPLTARPRSRKEKNKLASRACRLKKKAQYEANKVKLWGLNTEYDNLLFVINSIKQEIVNRVQNPRDERGPNMGQKLEILIKDTLGLPVAGQTSEFVNQVLEKTAEGNPTGGLVGLRIPTSKV

SEQ ID NO: 856241 - protein, 209 aa, Homo sapiens
MNYQQNPRDNFLSLEDCKDIENLESFTDVLDNEGALTSNWEQWDTYCEDLTKYTKLTSCDIWGTKEVDYLGLDDFSSPYQDEEVISKTPTLAQLNSEDSQSVSDSLYYPDSLFSVKQNPLPSSFPGKKITSRAAAPVCSSKTLQAEVPLSDCVQKASKPTSSTQIMVKTNMYHNEKVNFHVECKDYVKKAKVKINPVQQSRPLLSQIHT

SEQ ID NO: 856242 - protein, 342 aa, Homo sapiens; identical to SEQ ID NO: 856240

SEQ ID NO: 856243 - protein, 342 aa, Homo sapiens; identical to SEQ ID NO: 856240

SEQ ID NO: 856244 - protein, 293 aa, Homo sapiens
MCFSATTDLGRGAVGNVSVLGRMRTLQLGRWLGPRNVSAFLSACPAQAPPLGPRPTARERARSRAGGGGWGRIAGEITRRGSRARPRPGPQCPPGRPGTAMIKAILIFNNHGKPRLSKFYQPYSEDTQQQIIRETFHLVSKRDENVCNFLEGGLLIGGSDNKLIYRHYATLYFVFCVDSSESELGILDLIQVFVETLDKCFENVCELDLIFHVDKVHNILAEMVMGGMVLETNMNEIVTQIDAQNKLEKSEAGLAGAPARAVSAVKNMNLPEIPRNINIGDISIKVPNLPSFK

SEQ ID NO: 856245 - protein, 171 aa, Homo sapiens
MSEDTQQQIIRETFHLVSKRDENVCNFLEGGLLIGGSDNKLIYRHYATLYFVFCVDSSESELGILDLIQVFVETLDKCFENVCELDLIFHVDKVHNILAEMVMGGMVLETNMNEIVTQIDAQNKLEKSEAGLAGAPARAVSAVKNMNLPEIPRNINIGDISIKVPNLPSFK

SEQ ID NO: 856246 - protein, 159 aa, Homo sapiens
MCFSATTDLGRGAVGNVSVLGRMRTLQLGRWLGPRNVSAFLSACPAQAPPLGPRPTARERARSRAGGGGWGRIAGEITRRGSRARPRPGPQCPPGRPGTAMIKAILIFNNHGKPRLSKFYQPYSEDTQQQIIRETFHLVSKRDENVCNFLEGGLYLWKH

SEQ ID NO: 856247 - protein, 262 aa, Homo sapiens
MCFSATTDLGRGAVGNVSVLGRMRTLQLGRWLGPRNVSAFLSACPAQAPPLGPRPTARERARSRAGGGGWGRIAGEITRRGSRARPRPGPQCPPGRPGTAMIKAILIFNNHGKPRLSKFYQPYSEDTQQQIIRETFHLVSKRDENVCNFLEGGLLIGGSDNKLIYRHYATLYFVFCVDSSESELGILDLIQVFVETLDKCFENVCELDLIFHVDKVHNILAEMVMGGMVLETNMNEIVTQIDAQNKLEKSETFIFQSPRQDR

SEQ ID NO: 856248 - protein, 293 aa, Homo sapiens; identical to SEQ ID NO: 856244

SEQ ID NO: 856249 - protein, 293 aa, Homo sapiens; identical to SEQ ID NO: 856244

SEQ ID NO: 856250 - protein, 262 aa, Homo sapiens; identical to SEQ ID NO: 856247

SEQ ID NO: 856251 - protein, 181 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGKKVALYTNILYLFCLNCWFKKKKLLGEYKYIALGLVLIKAS

SEQ ID NO: 856252 - protein, 932 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDDLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 856253 - protein, 961 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDDLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKTLNINTKYYVLVINPAENESEIIPPIIYRYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 856254 - protein, 893 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDDLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 856255 - protein, 932 aa, Homo sapiens; identical to SEQ ID NO: 856252

SEQ ID NO: 856256 - protein, 932 aa, Homo sapiens; identical to SEQ ID NO: 856252

SEQ ID NO: 856257 - protein, 932 aa, Homo sapiens; identical to SEQ ID NO: 856252

SEQ ID NO: 856258 - protein, 320 aa, Homo sapiens
MILNSLRYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 856259 - protein, 623 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDDLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKSFNY

SEQ ID NO: 856260 - protein, 138 aa, Homo sapiens [sequence omitted]

SEQ ID NO: 856261 - protein, 123 aa, Homo sapiens
AAPPGRRPVFSVDTPRVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 856262 - protein, 932 aa, Homo sapiens; identical to SEQ ID NO: 856252

SEQ ID NO: 856263 - protein, 932 aa, Homo sapiens; identical to SEQ ID NO: 856252

SEQ ID NO: 856264 - protein, 747 aa, Homo sapiens
MQRKAARLIAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDVVNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 856265 - protein, 785 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDDLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTERSFNY

SEQ ID NO: 856266 - protein, 298 aa, Homo sapiens
MKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 856267 - protein, 133 aa, Homo sapiens
MILNSLRYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTESF

SEQ ID NO: 856268 - protein, 2812 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856269 - protein, 475 aa, Homo sapiens
MSQQNHLLMREGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLSGMDGGALTDASLTESYFSTSFIGVNGFGSPVETKYPLMQYTLVVFQRLRVCTSGFSNTKNTGPQTSHLLEPINFLLCLN

SEQ ID NO: 856270 - protein, 72 aa, Homo sapiens
APLGSTESDSGLKKGGNANLVFMLKRNSEQVVQSVVHLYELLSALQVRAFIFHPCVYLSREQQLGAVVDLDL

SEQ ID NO: 856271 - protein, 2812 aa, Homo sapiens; identical to SEQ ID NO: 856268

SEQ ID NO: 856272 - protein, 2812 aa, Homo sapiens; identical to SEQ ID NO: 856268

SEQ ID NO: 856273 - protein, 1713 aa, Homo sapiens
MAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856274 - protein, 2839 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQILLGGGQLMKPSSSMQSTDVSSVEFAEVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856275 - protein, 1465 aa, Homo sapiens
MPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856276 - protein, 1465 aa, Homo sapiens; identical to SEQ ID NO: 856275

SEQ ID NO: 856277 - protein, 2816 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGGESRTPALPVAIVSVHSERG

SEQ ID NO: 856278 - protein, 2722 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQILLGGGQLMKPSSSMQSTDVSSVEFAEVGKYPASTPS

SEQ ID NO: 856279 - protein, 1344 aa, Homo sapiens
MDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856280 - protein, 1057 aa, Homo sapiens
MSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856281 - protein, 1052 aa, Homo sapiens
SLHPIRQSGEEREEGQEDQKTFFEELAVEDKQADGRRCASSPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856282 - protein, 2365 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTHRVRARFVSC

SEQ ID NO: 856283 - protein, 859 aa, Homo sapiens [sequence omitted]

SEQ ID NO: 856284 - protein, 661 aa, Homo sapiens
MIRLELVPYACTTDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856285 - protein, 2324 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSTSLSWVHA

SEQ ID NO: 856286 - protein, 126 aa, Homo sapiens
MEVLGHFGQGSNGYLELALPSARGVSVCLRKWQSAIQDFRSNATALCHIRNQAWPQPEGTCSLMGKHTKNKRASRTCGACGPETAGNGSQARVAGRTHVAGSVGGSYRGKRPSQQLGEAATPLVDG

SEQ ID NO: 856287 - protein, 2182 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFQVRMQNGHETLAAWGNITSETIQDLCRVGSACKRVTVGAGGPRMGYTGTHRIQHAVRQIGRSQRRRVADAMSSTDIHTKTHRQARSRTTPLSADSLTI

SEQ ID NO: 856288 - protein, 323 aa, Homo sapiens
ETGLKNEGRVLVRHSAWCPLLWGREGSRSSLSSWPELQGSPLCASQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856289 - protein, 1350 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAECQT

SEQ ID NO: 856290 - protein, 1604 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRRYRVH

SEQ ID NO: 856291 - protein, 330 aa, Homo sapiens
PAKSPSPLPSPGSAGNNEQHVGPRRRQVKTLTAKLNAKDSRGIDEELGPNVGPKPHPTAAEPLIEQRKKEEQTTRSQPVSPRQKYQQRRRDLLLTLFLSAEAAASDPASPPLLRPRVHKSLTLTPTAPQQSSPPGRPQVLDNKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQ

SEQ ID NO: 856292 - protein, 1698 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDIFTALPPVPATIPVLI

SEQ ID NO: 856293 - protein, 155 aa, Homo sapiens [sequence omitted]

SEQ ID NO: 856294 - protein, 111 aa, Homo sapiens
SCIPPPFRTVSPSTNSRPFHSTFHNTSANLTESITEENYNFLPHSPSKKDSEWKSGTKVSRTFSYIKNKMSSSKKSKVSITVGIACDHLSRILSQPAFTPKLVKSWGHKWK

SEQ ID NO: 856295 - protein, 221 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTE

SEQ ID NO: 856296 - protein, 233 aa, Homo sapiens
ETGLKNEGRVLVRHSAWCPLLWGREGSRSSLSSWPELQGSPLCASQGVVLQQDSYIEDQKLVLSERALTRSLSRPSSLIEQEKQRSLEKQRQDLANLQKQQAQYLEEKRRREREWEARERELREREALLAQREEEVQQGQQDLEKKTKTRGAKGPPEREELQQKKGTYQYDLERLRAAQKQLEREQEQLRREAERLSQRQTERDLCQVMGLPAESNLMMILIKTPCVLSKVRK

SEQ ID NO: 856297 - protein, 1149 aa, Homo sapiens
MRPARRISISISPLLLKSKTLFSLGSSYSSDEEEELHNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856298 - protein, 213 aa, Homo sapiens
MTGERRPYACTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTHRVRARFVSC

SEQ ID NO: 856299 - protein, 2812 aa, Homo sapiens; identical to SEQ ID NO: 856268

SEQ ID NO: 856300 - protein, 2850 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKVLIRNMKIPVIVESHVSLSAFTESLFHVIPHSLFTPLQKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856301 - protein, 2722 aa, Homo sapiens; identical to SEQ ID NO: 856278

SEQ ID NO: 856302 - protein, 2841 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPAVHLCLYPPVWVNKAKRKKKGPEGQSQAPASTSASTRLFGLTKPKEKKEKKKKNKTSRSQPGDGPASEVSAEGEEIFC

SEQ ID NO: 856303 - protein, 2794 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856304 - protein, 2834 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSMSWCPSGVQYSAGLSADFNYRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856305 - protein, 2711 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVMGLPAESNLMMILIKTPCVLSKVRK

SEQ ID NO: 856306 - protein, 2722 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKKTKTRGAKGPPEREELQQKKGTYQYDLERLRAAQKQLEREQEQLRREAERLSQRQTERDLCQVMGLPAESNLMMILIKTPCVLSKVRK

SEQ ID NO: 856307 - protein, 1074 aa, Homo sapiens
MSIKWARFHEVPHITVRFIGPKHGEEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856308 - protein, 873 aa, Homo sapiens
MSQQNHLLMREGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856309 - protein, 1350 aa, Homo sapiens; identical to SEQ ID NO: 856289

SEQ ID NO: 856310 - protein, 660 aa, Homo sapiens
MTGERRPYACTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 856311 - protein, 2260 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKGKAWLFCLKYVPR

SEQ ID NO: 856312 - protein, 1966 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEEVVTTVIEALRGIGMGP

SEQ ID NO: 856313 - protein, 1779 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKVSITVGIACDHLSRILSQPAFTPKLVKSWGHKWK

SEQ ID NO: 856314 - protein, 1613 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSMSWCPLVCSTLLA

SEQ ID NO: 856315 - protein, 1564 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCFVSKCSMDICVLNPIK

SEQ ID NO: 856316 - protein, 1582 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRR

SEQ ID NO: 856317 - protein, 1374 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAAGLSTSSTAAELQHGMGNTSLTGLGGEHEGPAPPAIPEALNIKGNTDSSLQSMGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQASPLDVGVKNTQSQGKTSACEVSGNVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVTRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEALLEACVQQPMLQIRPHLHQAQGNTHSLLRQERLHELPSPVFPLFSDSRRGDWQEGQ

SEQ ID NO: 856318 - protein, 78 aa, Homo sapiens
EGRKDRGRALALDLLQREKLALVAFTSGFDDRQRNQQSNLMPASPHASAEELLQRKPALPALVFRTGAGWSLKTLFQQ

SEQ ID NO: 856319 - protein, 189 aa, Homo sapiens
HSLKGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAVCELI

SEQ ID NO: 856320 - protein, 69 aa, Homo sapiens
MMEVVVGNGVVALRGIPPRTSRKSSRKTRFCGERGSKQSGKCSPVGLAVVSLGGSRGSGKGLGRLEKRL

SEQ ID NO: 856321 - protein, 69 aa, Homo sapiens; identical to SEQ ID NO: 856320

SEQ ID NO: 856322 - protein, 69 aa, Homo sapiens; identical to SEQ ID NO: 856320

SEQ ID NO: 856323 - protein, 69 aa, Homo sapiens; identical to SEQ ID NO: 856320

SEQ ID NO: 856324 - protein, 69 aa, Homo sapiens; identical to SEQ ID NO: 856320

SEQ ID NO: 856325 - protein, 69 aa, Homo sapiens; identical to SEQ ID NO: 856320

SEQ ID NO: 856326 - protein, 69 aa, Homo sapiens; identical to SEQ ID NO: 856320

SEQ ID NO: 856327 - protein, 69 aa, Homo sapiens; identical to SEQ ID NO: 856320

SEQ ID NO: 856328 - protein, 69 aa, Homo sapiens; identical to SEQ ID NO: 856320

SEQ ID NO: 856329 - protein, 1022 aa, Homo sapiens
MRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTSRGRRNSHTRHQDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 856330 - protein, 103 aa, Homo sapiens
MSTPSRFKKDKEIIAEYESQVKEIRAQLVEQQKCLEQQTEMRVQLLQDLQDFFRKKAEIETEYSRNLEKLAERFMAKTNPACLPKTSPLALLVLEAMPEEEEE

SEQ ID NO: 856331 - protein, 1062 aa, Homo sapiens
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTSRGRRNSHTRHQDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 856332 - protein, 441 aa, Homo sapiens
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVSMRSSCHTSNLNSNITGRHSHMTWAYLIFKIQPLHHVFPALRVPVVLFVGDKCKDSVFCHRLIFY

SEQ ID NO: 856333 - protein, 270 aa, Homo sapiens
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDVST

SEQ ID NO: 856334 - protein, 680 aa, Homo sapiens
FSPILRKFALISILLLAAADITCRPMSILSILSLKLLIKIFVVVVVVGRNGFPTTNPSGPPLGEGHRAEYMTTRPPNVPPKPQKHRKSRPRSQYNTKLFNGDLETFVKDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 856335 - protein, 441 aa, Homo sapiens; identical to SEQ ID NO: 856332

SEQ ID NO: 856336 - protein, 906 aa, Homo sapiens
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTSRGRRNSHTRHQDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLHIATLVEMQLH

SEQ ID NO: 856337 - protein, 735 aa, Homo sapiens
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTSRGRRNSHTRHQDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDGMLSPYAIIKPVFISLL

SEQ ID NO: 856338 - protein, 2492 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 856339 - protein, 2533 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGVLWWISLYLIPCAHVGENLQRITKFCLILERCMHQSTEKILKDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 856340 - protein, 90 aa, Homo sapiens [sequence omitted]

SEQ ID NO: 856341 - protein, 2492 aa, Homo sapiens; identical to SEQ ID NO: 856338

SEQ ID NO: 856342 - protein, 2492 aa, Homo sapiens; identical to SEQ ID NO: 856338

SEQ ID NO: 856343 - protein, 1759 aa, Homo sapiens
MLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 856344 - protein, 2390 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAI

SEQ ID NO: 856345 - protein, 615 aa, Homo sapiens [sequence omitted]

SEQ ID NO: 856346 - protein, 2150 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGELQIFLCRNFKNTDLNIPYKHFSNKRNKTTQSHNSIISKFFCNVYLSLSIYMYSLFQNKIVLFIFEVYNMVLWDTYR

SEQ ID NO: 856347 - protein, 1007 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKKKKKKRKLGLGFALGITGLE

SEQ ID NO: 856348 - protein, 1871 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTVLHLNKMGMLKSIKYF

SEQ ID NO: 856349 - protein, 1618 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVRAEEYEGILFLWIH

SEQ ID NO: 856350 - protein, 1331 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRYDSICKDFKKIITHPRHGHKQQQRNSKQVVKTRSACLRKTRSQSSCKFERKARKWAKTQKP

SEQ ID NO: 856351 - protein, 2454 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 856352 - protein, 2492 aa, Homo sapiens; identical to SEQ ID NO: 856338

SEQ ID NO: 856353 - protein, 2492 aa, Homo sapiens; identical to SEQ ID NO: 856338

SEQ ID NO: 856354 - protein, 1268 aa, Homo sapiens
MVDSYRYPLCESHSTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 856355 - protein, 194 aa, Homo sapiens
TVCCFYNFFSSLINEVLQLLITHCCQGSQIERNVRSLRVETDSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 856356 - protein, 2125 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISYLTDQRNSR

SEQ ID NO: 856357 - protein, 1725 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGKVLIDSDIKKQVE

SEQ ID NO: 856358 - protein, 1335 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKLETLKRRVPLLLQKNAVPHQQRNKAGWRMI

SEQ ID NO: 856359 - protein, 1064 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGNWHCAGIKMRHFFSLFLIRLSSSCNC

SEQ ID NO: 856360 - protein, 90 aa, Homo sapiens [sequence omitted]

SEQ ID NO: 856361 - protein, 78 aa, Homo sapiens
SLSLWPPLLQAHGRYCLATADVHSKPRPSSVSLCFAGNLELWETSPNLFHVCKILPLRGWRLDKVYKEAPCILSYICM

SEQ ID NO: 856362 - protein, 1320 aa, Homo sapiens
LPTLMLLLLTLLPAAIEKGKGKAKKGSSFQTVSALHRENLNKLMTNLRSTHPHFVRCIIPNETKSPGVMDNPLVMHQLRCNGVLEGIRICRKGFPNRILYGDFRQRYRILNPAAIPEGQFIDSRKGAEKLLSSLDIDHNQYKFGHTKVFFKAGLLGLLEEMRDERLSRIITRIQAQSRGVLARMEYKKLLERRDSLLVIQWNIRAFMGVKNWPWMKLYFKIKPLLKSAEREKEMASMKEEFTRLKEALEKSEARRKELEEKMVSLLQEKNDLQLQVQAEQDNLADAEERCDQLIKNKIQLEAKVKEMNERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQQVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 856363 - protein, 414 aa, Homo sapiens
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEDLVDKLQLKVKAYKRQAEEAEEQANTNLSKFRKVQHELDEAEERADIAESQVNKLRAKSRDIGTKGLNEE

SEQ ID NO: 856364 - protein, 614 aa, Homo sapiens
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVIYATGALAKAVYERMFNWMVTRINATLETKQPRQYFIGVLDIAGFEIFDFNSFEQLCINFTNEKLQQFFNHHMFVLEQEEYKKEGEEQANTNLSKFRKVQHELDEAEERADIAESQVNKLRAKSRDIGTKGGSLFWALLVTPTAGIPRQSTLKPGMLPFHLFHTLEPHGPRGQGNAVLCDFKDSSSSNFFFFFF

SEQ ID NO: 856365 - protein, 394 aa, Homo sapiens
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEVIHKHFYLKRVEIMAQCEEWIADIQQYSSYKRVGRTMSHHAAALKRHTAQ

SEQ ID NO: 856366 - protein, 635 aa, Homo sapiens
LLGVGELASGQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 856367 - protein, 1011 aa, Homo sapiens
MLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQQVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 856368 - protein, 492 aa, Homo sapiens
KSEPVPGQILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 856369 - protein, 555 aa, Homo sapiens
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVIYATGALAKAVYERMFNWMVTRINATLETKQPRQYFIGVLDIAGFEIFDFNSFEQLCINFTNEKLQQFFNHHMFVLEQEEYKKEGEEQANTNLSKFRKVQHELDEAEERADIAESQVNKLRAKSRDIGTKGLNEE

SEQ ID NO: 856370 - protein, 378 aa, Homo sapiens
SEQGRARPVLRGGPVRVRQPRGSARPPPNPRLPSAPPSLSALTSPPKTPYLAKGRRSGERSPLPFQKTKTEKPFSRPGKAGGRGAAGLAMELLCHEVDPVRRAVRDRNLLRDDRVLQNLLTIEERYLPQCSYFKCVQKDIQPYMRRMVATWMLEVCEEQKCEEEVFPLAMNYLDRFLAGVPTPKSHLQLLGAVCMFLASKLKETSPLTAEKLCIYTDNSIKPQELLEWELVVLGKLKWNLAAVTPHDFIEHILRKLPQQREKLSLIRKHAQTFIALCATDFKFAMYPPSMIATGSVGAAICGLQQDEEVSSLTCDALTELLAKITNTDVDCLKACQEQIEAVLLNSLQQYRQDQRDGSKSEDELDQASTPTDVRDIDL

SEQ ID NO: 856371 - protein, 289 aa, Homo sapiens
MELLCHEVDPVRRAVRDRNLLRDDRVLQNLLTIEERYLPQCSYFKCVQKDIQPYMRRMVATWMLEVCEEQKCEEEVFPLAMNYLDRFLAGVPTPKSHLQLLGAVCMFLASKLKETSPLTAEKLCIYTDNSIKPQELLEWELVVLGKLKWNLAAVTPHDFIEHILRKLPQQREKLSLIRKHAQTFIALCATDFKFAMYPPSMIATGSVGAAICGLQQDEEVSSLTCDALTELLAKITNTDVDCLKACQEQIEAVLLNSLQQYRQDQRDGSKSEDELDQASTPTDVRDIDL

SEQ ID NO: 856372 - protein, 289 aa, Homo sapiens; identical to SEQ ID NO: 856371

SEQ ID NO: 856373 - protein, 102 aa, Homo sapiens [sequence omitted]

SEQ ID NO: 856374 - protein, 378 aa, Homo sapiens; identical to SEQ ID NO: 856370

SEQ ID NO: 856375 - protein, 378 aa, Homo sapiens; identical to SEQ ID NO: 856370

SEQ ID NO: 856376 - protein, 126 aa, Homo sapiens
MGGPVRVRQPRGSARPPPNPRLPSAPPSLSALTSPPKTPYLAKGRRSGERSPLPFQKTKTDMELLCHEVDPVRRAVRDRNLLRDDRVLQNLLTIEERYLPQCSYFKCVQKDIQPYMRRMVATWMLE

SEQ ID NO: 856377 - protein, 343 aa, Homo sapiens
SEQGRARPVLRGGPVRVRQPRGSARPPPNPRLPSAPPSLSALTSPPKTPYLAKGRRSGERSPLPFQKTKTEKPFSRPGKAGGRGAAGLAMELLCHEVDPVRRAVRDRNLLRDDRVLQNLLTIEERYLPQCSYFKCVQKDIQPYMRRMVATWMLEVCEEQKCEEEVFPLAMNYLDRFLAGVPTPKSHLQLLGAVCMFLASKLKETSPLTAEKLCIYTDNSIKPQELLEWELVVLGKLKWNLAAVTPHDFIEHILRKLPQQREKLSLIRKHAQTFIALCATAQQVGQGKGKGCNQEMPQERLRGVSKSQRPAPDSISASFRVARRLLLLRHVCHVQHSSQTHSLD

SEQ ID NO: 856378 - protein, 306 aa, Homo sapiens
SEQGRARPVLRGGPVRVRQPRGSARPPPNPRLPSAPPSLSALTSPPKTPYLAKGRRSGERSPLPFQKTKTEKPFSRPGKAGGRGAAGLAMELLCHEVDPVRRAVRDRNLLRDDRVLQNLLTIEERYLPQCSYFKCVQKDIQPYMRRMVATWMLEVCEEQKCEEEVFPLAMNYLDRFLAGVPTPKSHLQLLGAVCMFLASKLKETSPLTAEKLCIYTDNSIKPQELLEWELVVLGKLKWNLAAVTPHDFIEHILRKLPQQREKLSLIRKHAQTFIALCATDFKFAMYPPSMIATGSVGAAICGLQHE

SEQ ID NO: 856379 - protein, 399 aa, Homo sapiens
SEQGRARPVLRGGPVRVRQPRGSARPPPNPRLPSAPPSLSALTSPPKTPYLAKGRRSGERSPLPFQKTKTEKPFSRPGKAGGRGAAGLAMELLCHEVDPVRRAVRDRNLLRDDRVLQNLLTIEERYLPQCSYFKCVQKDIQPYMRRMVATWMLELVRVRQPRGSARTTTQSSPLFCSSFYFSALTSPPKTPYVAKGRRSGERSSPPLPEKHEHQNKAYTRPGGNAGGDEGPPGWPCEHSRVPTSVDPGPTGPMRQHSATRHRRTDTAPPCQNPAYTSPRTTLPTGSGLRTPTQRRQAQGPSQPLTNDGRKWDGRHTWRHATTHVPRRRNHDTYSGHETQRRPITAKTWSPLCNFQTRWGAPGDPLGGLGESSPRIHREKVPPLFTPGTTPGGMTLATTK

SEQ ID NO: 856380 - protein, 108 aa, Homo sapiens
HAERLAPPLWGALPQLTLAPPVDVAIHSPELPCPARITLLRDKAGAHACARLELVTPGCRNPGRVDTAARDDRGKQCDAISSPCYSLTVYSIRGVGVCLVRMLESADK

SEQ ID NO: 856381 - protein, 378 aa, Homo sapiens; identical to SEQ ID NO: 856370

SEQ ID NO: 856382 - protein, 378 aa, Homo sapiens; identical to SEQ ID NO: 856370

SEQ ID NO: 856383 - protein, 209 aa, Homo sapiens
MELLCHEVDPVRRAVRDRNLLRDDRVLQNLLTIEERYLPQCSYFKCVQKDIQPYMRRMVATWMLEVCEEQKCEEEVFPLAMNYLDRFLAGVPTPKSHLQLLGAVCMFLASKLKETSPLTAEKLCIYTDNSIKPQELLVMTGPFLPSFLRFPLSPGQQYAFYHHCQSKFLGSRMTPPIEFTHLWAIAHLIGNHCLFFVCSYYVPRLRAQH

SEQ ID NO: 856384 - protein, 289 aa, Homo sapiens; identical to SEQ ID NO: 856371

SEQ ID NO: 856385 - protein, 515 aa, Homo sapiens
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACICLLTFVNCAYVKWGTRVQDTFTYAKVVALIAIIVMGLVKLCQGHSEHFQDAFEGSSWDMGNLSLALYSALFSYSGWDTLNFVTEEIKNPERNLPLAIGISMPIVTLIYILTNVAYYTVLNISDVLSSDAVAVTFADQTFGMFSWTIPIAVALSCFGGLNASIFASSRLFFVGSREGHLPDLLSMIHIERFTPIPALLFNCTMALIYLIVEDVFQLINYFSFSYWFFVGLSVVGQLYLRWKEPKRPRPLKLSVFFPIVFCICSVFLVIVPLFTDTINSLIGIGIALSGVPFYFMGVYLPESRRPLFIRNVLAAITRGTQQLCFCVLTELDVAEEKKDERKTD

SEQ ID NO: 856386 - protein, 515 aa, Homo sapiens; identical to SEQ ID NO: 856385

SEQ ID NO: 856387 - protein, 158 aa, Homo sapiens [sequence omitted]

SEQ ID NO: 856388 - protein, 515 aa, Homo sapiens; identical to SEQ ID NO: 856385

SEQ ID NO: 856389 - protein, 99 aa, Homo sapiens
PLPTLLNLSPPLFQLSVFFPIVFCICSVFLVIVPLFTDTINSLIGIGIALSGVPFYFMGVYLPESRRPLFIRNVLGELLCAPLLTGGYVCMRMQRWGVA

SEQ ID NO: 856390 - protein, 515 aa, Homo sapiens; identical to SEQ ID NO: 856385

SEQ ID NO: 856391 - protein, 515 aa, Homo sapiens; identical to SEQ ID NO: 856385

SEQ ID NO: 856392 - protein, 493 aa, Homo sapiens
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACICLLTFVNCAYVKWGTRVQDTFTYAKVVALIAIIVMGLVKLCQGHSEHFQDAFEGSSWDMGNLSLALYSALFSYSGWDTLNFVTEEIKNPERNLPLAIGISMPIVTLIYILTNVAYYTVLNISDVLSSDAVAVTFADQTFGMFSWTIPIAVALSCFGGLNASIFASSRLFFVGSREGHLPDLLSMIHIERFTPIPALLFNCTMALIYLIVEDVFQLINYFSFSYWFFVGLSVVGQLYLRWKEPKRPRPLKLSVFFPIVFCICSVFLVIVPLFTDTINSLIGIGIALSGVPFYFMGVYLPESRRPFSGEKVYTEVDEMNGN

SEQ ID NO: 856393 - protein, 68 aa, Homo sapiens
FFPDRVTLGFLRASAPVAFQIIHWQKHHFLHVVFREVPNAERKGGVAGARLAASTSLVQVILLPQSPK

SEQ ID NO: 856394 - protein, 103 aa, Homo sapiens
ACWSSLHGSPFYLKAAAGEFADDPCSSVKRGNMVRAARALLSAVTRLLILADMADVYKLLVQLKVVEDGILKLRNAGNEQDLGIQYKALKPEVDKLNIMAAFR

SEQ ID NO: 856395 - protein, 906 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856396 - protein, 906 aa, Homo sapiens; identical to SEQ ID NO: 856395

SEQ ID NO: 856397 - protein, 906 aa, Homo sapiens; identical to SEQ ID NO: 856395

SEQ ID NO: 856398 - protein, 906 aa, Homo sapiens; identical to SEQ ID NO: 856395

SEQ ID NO: 856399 - protein, 841 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGNCDTCGALQGLKGWPPPLCWPLTGWTAPCP

SEQ ID NO: 856400 - protein, 865 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGQELDECCGADSEGILRRLYQIPKVTGYGFPQPSCCVMEDEGTREKAIGEERETG

SEQ ID NO: 856401 - protein, 810 aa, Homo sapiens
MSRTGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856402 - protein, 906 aa, Homo sapiens; identical to SEQ ID NO: 856395

SEQ ID NO: 856403 - protein, 717 aa, Homo sapiens
MAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856404 - protein, 906 aa, Homo sapiens; identical to SEQ ID NO: 856395

SEQ ID NO: 856405 - protein, 678 aa, Homo sapiens
MLHDLTPYVKPKKYIPYQQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856406 - protein, 906 aa, Homo sapiens; identical to SEQ ID NO: 856395

SEQ ID NO: 856407 - protein, 906 aa, Homo sapiens; identical to SEQ ID NO: 856395

SEQ ID NO: 856408 - protein, 906 aa, Homo sapiens; identical to SEQ ID NO: 856395

SEQ ID NO: 856409 - protein, 600 aa, Homo sapiens
LRTRRSLCGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856410 - protein, 455 aa, Homo sapiens
MSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856411 - protein, 906 aa, Homo sapiens; identical to SEQ ID NO: 856395

SEQ ID NO: 856412 - protein, 257 aa, Homo sapiens
GETRFEDIVTMSMIAGASAQRSSWFNCRRQCQAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856413 - protein, 240 aa, Homo sapiens
MTLTLRQKILMSEAGRASRQKTISFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856414 - protein, 779 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPIACSRTVATDD

SEQ ID NO: 856415 - protein, 186 aa, Homo sapiens
MIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856416 - protein, 126 aa, Homo sapiens
VRHDGARSMNSLQQRSRPEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856417 - protein, 132 aa, Homo sapiens
MLPAEILHPGLDLAADVQLVAVEGDALQVGQQVLLASRVGAMVCNGAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856418 - protein, 488 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEVFPALGLQQKNLTT

SEQ ID NO: 856419 - protein, 463 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVK

SEQ ID NO: 856420 - protein, 366 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISWLPTKWGFGKRNSAARWYRSWSCPWRRTELPAPGNSRFMPWLERIRAREAGGAPLGYSQPSGCHCAKLGCLPLRALHFGGQ

SEQ ID NO: 856421 - protein, 278 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQTA

SEQ ID NO: 856422 - protein, 223 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAFR

SEQ ID NO: 856423 - protein, 906 aa, Homo sapiens; identical to SEQ ID NO: 856395

SEQ ID NO: 856424 - protein, 935 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856425 - protein, 906 aa, Homo sapiens; identical to SEQ ID NO: 856395

SEQ ID NO: 856426 - protein, 906 aa, Homo sapiens; identical to SEQ ID NO: 856395

SEQ ID NO: 856427 - protein, 775 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPGWTAPCP

SEQ ID NO: 856428 - protein, 815 aa, Homo sapiens
RLLVVSAGSPFYLKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856429 - protein, 904 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856430 - protein, 906 aa, Homo sapiens; identical to SEQ ID NO: 856395

SEQ ID NO: 856431 - protein, 555 aa, Homo sapiens
MGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856432 - protein, 906 aa, Homo sapiens; identical to SEQ ID NO: 856395

SEQ ID NO: 856433 - protein, 414 aa, Homo sapiens
YRTRAGTLSPHPSLTLDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856434 - protein, 643 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENCSSLK

SEQ ID NO: 856435 - protein, 272 aa, Homo sapiens
ANVKPVCSGMDPSPGTKCSAEGHTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 856436 - protein, 803 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLKKPDNIVFAKAVI

SEQ ID NO: 856437 - protein, 687 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQIHHWAHF

SEQ ID NO: 856438 - protein, 1130 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSESKRTRTTLCGVITERECMRSSASERLMQAGIDGLRSLPGTYSVGVILPPGDTTQAKIAEQVASFQEEKSKLDAEVSKWDDSGNDIIVLAKQMCMIMMEMTDFTRGKGPLKNTSDVISAAKKIAEAGSRMDKLGRTIADHCPTIADHCPDSACMQDLLAYLQRIALYCHQLNICSKVKAEVQNLGAGACVSGVDSAMSLIQAAKQLDDMRWLQTAATALHTLASYQTTTTAHTGYWPSAHTSPCHAAHCDTTRNGNQARTHNAPLWLHSTQHANHATGRPTETHTHLHTGRQSYKPTHSHTLDTPRARPSGPLHPRTLSHHALTRRTMPHYFTRLPVPPTETSGARKTRHTETTDLSRVTIPLATAKFKRIDLGISDSQPFQNLKNYWPLDIIQHQHCNLPVRKLYPQSIRGVTTPGVPTGTYLANTSTPSATAPWPHATSFSIRTYGKTTVTAYSKTAY

SEQ ID NO: 856439 - protein, 502 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVKVQLTLVTA

SEQ ID NO: 856440 - protein, 111 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLARREFGSTSVERVQSRQLDCF

SEQ ID NO: 856441 - protein, 295 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLTAVQHMPSHCLNILTRWR

SEQ ID NO: 856442 - protein, 206 aa, Homo sapiens
RLGTRLGVESAEASASGLWNLALAQLAAEMTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVSIQAYVCNLFYHRKIATGLP

SEQ ID NO: 856443 - protein, 73 aa, Homo sapiens
SLSAPFCLGSGGRSSIAFYVSGEKGTEFSSGRLVFVRPSSTVSSRTAPSRGRRSLRAVRKVSICTVKHFATQK

SEQ ID NO: 856444 - protein, 96 aa, Homo sapiens
SLSAPFCLGSGGRSSIAFYVSGEKGTEFSSGRLVFVRPSSTVSSRTAPSRGRRSLRAVRKNKTDFMGKLSRCSSLRNLDLRSVCGTSIKMIYGNKI

SEQ ID NO: 856445 - protein, 73 aa, Homo sapiens; identical to SEQ ID NO: 856443

SEQ ID NO: 856446 - protein, 68 aa, Homo sapiens
ACRRHFVSAAVAVAPSHFMFLARRERSFHQVDWFLCGRPPPFPPGQHLVVAGGVSELSERIRLILWEN

SEQ ID NO: 856447 - protein, 148 aa, Homo sapiens
SLSAPFCLGSGGRSSIAFYVSGEKGTEFSSGRLVFVRPSSTVSSRTAPSRGRRSLRAVRKNKTDFMGKLSRCSSLRNLDLRSVCEWYSVKRTIISYKPHQRRLKMKKLPSPYITNLCCAPTRTCFKFPWQFTTPILYQARYQHQDDLW

SEQ ID NO: 856448 - protein, 624 aa, Homo sapiens
GPSRAERLELGLGRERPAKAIFLHRRPGEGGGRERCLRCGHVCVRRGPGPREAVPSGRPRPDTLTPPWVRQRAVTGTFCASWTPLRNRRAQRMATDMQRKRSSECLDGTLTPSDGQSMERAESPTPGMAQGMEPGAGQEGAMFVHARSYEDLTESEDGAASGDSHKEGTRGPPPLPTDMRQISQDFSELSTQLTGVARDLQEEMLPGSSEDWLEPPGAVGRPATEPPREGTTEGDEEDATEAWRLHQKHVFVLSEAGKPVYSRYGSEEALSSTMGVMVALVSFLEADKNAIRSIHADGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVRQPWDGLGFMEVLGMGHEGPLT

SEQ ID NO: 856449 - protein, 609 aa, Homo sapiens
GPSRAERLELGLGRERPAKAIFLHRRPGEGGGRERCLRCGHVCVRRGPGPREAVPSGRPRPDTLTPPWVRQRAVTGTFCASWTPLRNRRAQRMATDMQRKRSSECLDGTLTPSDGQSMERAESPTPGMAQGMEPGAGQEGAMFVHARSYEDLTESEDGAASGDSHKEGTRGPPPLPTDMRQISQDFSELSTQLTGVARDLQEEMLPGSSEDWLEPPGAVGRPATEPPREGTTEGDEEDATEAWRLHQKHVFVLSEAGKPVYSRYGSEEALSSTMGVMVALVSFLEADKNAIRSIHADGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWDERAEFCE

SEQ ID NO: 856450 - protein, 378 aa, Homo sapiens
KSCAGRRFSEGAAAEADILLSCPALRWHGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVTGAFELYMCYSPLGTKASAVSAIHKLMRWIRKEEDRLFILTPLTY

SEQ ID NO: 856451 - protein, 258 aa, Homo sapiens
GPSRAERLELGLGRERPAKAIFLHRRPGEGGGRERCLRCGHVCVRRGPGPREAVPSGRPRPDTLTPPWVRQRAVTGTFCASWTPLRNRRAQRMATDMQRKRSSECLDGTLTPSDGQSMERAESPTPGMAQGMEPGAGQEGAMFVHARSYEDLTESEDGAASGDSHKEGTRGPPPLPTDMRQISQDFSELSTQLTGWPATSSWHSCAERTNFCTPSDLHLLFNLISSSSSFREGEAWTPVCLPKFNAVSLPGHTRCGKP

SEQ ID NO: 856452 - protein, 647 aa, Homo sapiens
GPSRAERLELGLGRERPAKAIFLHRRPGEGGGRERCLRCGHVCVRRGPGPREAVPSGRPRPDTLTPPWVRQRAVTGTFCASWTPLRNRRAQRMATDMQRKRSSECLDGTLTPSDGQSMERAESPTPGMAQGMEPGAGQEGAMFVHARSYEDLTESEDGAASGDSHKEGTRGPPPLPTDMRQISQDFSELSTQLTGVARDLQEEMLPGSSEDWLEPPGAVGRPATEPPREGTTEGDEEDATEAWRLHQKHVFVLSEAGKPVYSRYGSEEALSSTMGVMVALVSFLEADKNAIRSIHADGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVTGAFELYMCYSPLGTKASAVSAIHKLMRWIRKEEDRLFILTPLTY

SEQ ID NO: 856453 - protein, 555 aa, Homo sapiens
MATDMQRKRSSECLDGTLTPSDGQSMERAESPTPGMAQGMEPGAGQEGAMFVHARSYEDLTESEDGAASGDSHKEGTRGPPPLPTDMRQISQDFSELSTQLTGVARDLQEEMLPGSSEDWLEPPGAVGRPATEPPREGTTEGDEEDATEAWRLHQKHVFVLSEAGKPVYSRYGSEEALSSTMGVMVALVSFLEADKNAIRSIHADGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVTGAFELYMCYSPLGTKASAVSAIHKLMRWIRKEEDRLFILTPLTY

SEQ ID NO: 856454 - protein, 485 aa, Homo sapiens
GPSRAERLELGLGRERPAKAIFLHRRPGEGGGRERCLRCGHVCVRRGPGPREAVPSGRPRPDTLTPPWVRQRAVTGTFCASWTPLRNRRAQRMATDMQRKRSSECLDGTLTPSDGQSMERAESPTPGMAQGMEPDGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVTGAFELYMCYSPLGTKASAVSAIHKLMRWIRKEEDRLFILTPLTY

SEQ ID NO: 856455 - protein, 266 aa, Homo sapiens
DKNAIRSIHADGYKVVFVCLPKFNAAGFFHAHISYLEPVQTFIVIWLQGSIRAPEPAGASGGGSYAAVGTRAGAGAALHLLPDPKPGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVTGAFELYMCYSPLGTKASAVSAIHKLMRWIRKEEDRLFILTPLTY

SEQ ID NO: 856456 - protein, 459 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856457 - protein, 459 aa, Homo sapiens; identical to SEQ ID NO: 856456

SEQ ID NO: 856458 - protein, 296 aa, Homo sapiens
ARYPSILNLELTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856459 - protein, 366 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLHGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856460 - protein, 437 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856461 - protein, 231 aa, Homo sapiens [sequence omitted]

SEQ ID NO: 856462 - protein, 254 aa, Homo sapiens
HPAGGSTQCPPSLSSPESSHPILMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856463 - protein, 400 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLCEYLLFLCGPGHQLKSKPPEARSLSLSPVQV

SEQ ID NO: 856464 - protein, 307 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHPKLPKPYITINNLNPRENKDVLTFTCEPKSENYTYIWWLNGQSLPVSPRVKRPIENRILILPNVTRNETGPYQCEIRDRYGGIRSDPVTLNVLCEYLLFLCGPGHQLKSKPPEARSLSLSPVQV

SEQ ID NO: 856465 - protein, 459 aa, Homo sapiens; identical to SEQ ID NO: 856456

SEQ ID NO: 856466 - protein, 100 aa, Homo sapiens
EEIRHFTFTLYLETPKPYISSSNLNPREAMEAVRLICDPETLDASYLWWMNGQSLPVTHRLQLSKTNRTLYLFGVTKYIAGPYECEIRNPVSASRMTQSP

SEQ ID NO: 856467 - protein, 466 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSGKWIPASLAIGI

SEQ ID NO: 856468 - protein, 400 aa, Homo sapiens; identical to SEQ ID NO: 856463

SEQ ID NO: 856469 - protein, 373 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLHGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 856470 - protein, 386 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSITLLSSSRVL

SEQ ID NO: 856471 - protein, 346 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLAFTCEPKSENYTYIWWLNGQSLPVSPGVKRPIENRILILPSVTRNETG

SEQ ID NO: 856472 - protein, 335 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLREYPLFLCEPGCHPKYTWPEARPLSPSQVQVQRPLPLDIKAGHDFLPQAKQSRPRLDPQ

SEQ ID NO: 856473 - protein, 273 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVKLTLHAAQIY

SEQ ID NO: 856474 - protein, 132 aa, Homo sapiens
WYLSVSGLHREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSSL

SEQ ID NO: 856475 - protein, 142 aa, Homo sapiens
NNESRIRDRITWTFDLNLYTWPEARPLSPSQVQVQMTHRLQLSKTNRTLFIFGVTKYIAGPYECEIRNPVSASRSDPVTLNLLREYPLFLCEPGCHPKYTWPEARPLSPSQVQVQRPLPLDIKAGHDFLPQAKQSRPRLDPQ

SEQ ID NO: 856476 - protein, 459 aa, Homo sapiens; identical to SEQ ID NO: 856456

SEQ ID NO: 856477 - protein, 461 aa, Homo sapiens
INAECPLRRGEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856478 - protein, 435 aa, Homo sapiens
MKHCPQQETSTIGGKKKHPEGGDPENSHIYRSLPPVPASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856479 - protein, 408 aa, Homo sapiens
RSDYAAEGGPASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856480 - protein, 270 aa, Homo sapiens
WYLSVSGLHREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856481 - protein, 231 aa, Homo sapiens [sequence omitted]

SEQ ID NO: 856482 - protein, 340 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILRTLSM

SEQ ID NO: 856483 - protein, 218 aa, Homo sapiens
SVPARPSLHIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856484 - protein, 366 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856485 - protein, 194 aa, Homo sapiens
RLEDPIEHTLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856486 - protein, 382 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLFRRKPLLVLLRRV

SEQ ID NO: 856487 - protein, 159 aa, Homo sapiens
VSQCDVYTNVLCSLNQCLILPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856488 - protein, 157 aa, Homo sapiens
MLFSCPRAWKEGIESAQCIDKNSSLEADSPMKCTFRYSGSPCLGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856489 - protein, 103 aa, Homo sapiens
LEDPAGALTSGSLNGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 856490 - protein, 506 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSGHISNHWLYYQGFDWDVIFKNIDRMNQYELQAKSEVSLGLASYSQGFCKSLI

SEQ ID NO: 856491 - protein, 400 aa, Homo sapiens; identical to SEQ ID NO: 856463

SEQ ID NO: 856492 - protein, 321 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPRENKDVLTFTCEPKSENYTYIWWLNGQSSL

SEQ ID NO: 856493 - protein, 373 aa, Homo sapiens; identical to SEQ ID NO: 856469

SEQ ID NO: 856494 - protein, 266 aa, Homo sapiens
LPREEAQTEGGRTAQLTAVLRKLLDPRLISTEENTQAAETMGPLSAPPCTHLITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHQSEHNMRSKLLTTFYGKITVLRIEHRKSRNPQSEMLQNSTLLTTDVMLKRSAHWRIVDFKFFRFGMLNQYMYCKYSKIKKIRN

SEQ ID NO: 856495 - protein, 148 aa, Homo sapiens
TLMKYACGGIKGATQDNLLSVIHTAKLPKPYITINNLNPRENKDVLTFTCEPKSENYTYIWWLNGQSLPVSPRVKRPIENRILILPNVTRNETGPYQCEIRDRYGGIRSDPVTLNVLCEYLLFLCGPGHQLKSKPPEARSLSLSPVQV

SEQ ID NO: 856496 - protein, 1121 aa, Homo sapiens
RGCDGADAGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 856497 - protein, 1121 aa, Homo sapiens; identical to SEQ ID NO: 856496

SEQ ID NO: 856498 - protein, 717 aa, Homo sapiens
GCVNRDHGEKFYRSNNSFANPKTVGSYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 856499 - protein, 590 aa, Homo sapiens
DQLARLSSESRHGRKMEIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 856500 - protein, 485 aa, Homo sapiens
MCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 856501 - protein, 824 aa, Homo sapiens
RGCDGADAGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGFR

SEQ ID NO: 856502 - protein, 235 aa, Homo sapiens
RGCDGADAGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREVS

SEQ ID NO: 856503 - protein, 1121 aa, Homo sapiens; identical to SEQ ID NO: 856496

SEQ ID NO: 856504 - protein, 1121 aa, Homo sapiens; identical to SEQ ID NO: 856496

SEQ ID NO: 856505 - protein, 1121 aa, Homo sapiens; identical to SEQ ID NO: 856496

SEQ ID NO: 856506 - protein, 1121 aa, Homo sapiens; identical to SEQ ID NO: 856496

SEQ ID NO: 856507 - protein, 926 aa, Homo sapiens
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKRGSPYSLNFRVKFFVSDPNKLQEEYTRYQYFLQIKQDILTGRLPCPSNTAALLASFAVQSELGDYDQSENLSGYLSDYSFIPNQPQDFEKEIAKLHQQHIGLSPAEAEFNYLNTARTLELYGVEFHYARDQSNNEIMIGVMSGGILIYKNRVRMNTFPWLKIVKISFKCKQFFIQLRKELHESRETLLGFNMVNYRACKNLWKACVEHHTFFRLDRPLPPQKNFFAHYFTLGSKFRYCGRTEVQSVQYGKEKANKDRVFARSPSKPLARKLMDWEVVSRNSISDDRLETQSLPSRSPPGTPNHRNSTFTQEGTRLRPSSVGHLVDHMVHTSPSEVFVNQRSPSSTQANSIVLESSPSQETPGDGKPPALPPKQSKKNSWNQIHYSHSQQDLESHINETFDIPSSPEKPTPNGGIPHDNLVLIRMKPDENGRFGFNVKGGYDQKMPVIVSRVAPGTPADLCVPRLNEGDQVVLINGRDIAEHTHDQVVLFIKASCERHSGELMLLVRPNAVYDVVEEKLENEPDFQYIPEKAPLDSVHQDDHSLRESMIQLAEGLITGTVLTQFDQLYRKKPGMTMSCAKLPQNISKNRYRDISPYDATRVILKGNEDYINANYINMEIPSSSIINQYIACQGPLPHTCTDFWQMTWEQGSSMVVMLTTQVERGRVKCHQYWPEPTGSSSYGCYQVTCHSEEGNTAYIFRKMTLFNQEKNESRPLTQIQYIAWPDHGVPDDSSDFLDFVCHVRNKRAGKEEPVVVHCSAGIGRTGVLITMETAMCLIECNQPVYPLDIVRTMRDQRAMMIQTPSQYRFVCEAILKVYEEGFVKPLTTSTNK

SEQ ID NO: 856508 - protein, 150 aa, Homo sapiens
DLPSPPTGASLKFYVPCKQCPPMKKESVKCHQYWPEPTGSSSYGCYQVTCHSEEGNTAYIFRKMTLFNQEKNESRPLTQIQYIAWPDHGVPDDSSDFLDFVCHVRNKRAGKEEPVVVHCSAGIREDLGLLLQWNRTGRPVRKMAAQQLGI

SEQ ID NO: 856509 - protein, 639 aa, Homo sapiens [sequence omitted]

SEQ ID NO: 856510 - protein, 749 aa, Homo sapiens
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKRGSPYSLNFRVKFFVSDPNKLQEEYTRYQYFLQIKQDILTGRLPCPSNTAALLASFAVQSELGDYDQSENLSGYLSDYSFIPNQPQDFEKEIAKLHQQHIGLSPAEAEFNYLNTARTLELYGVEFHYARDQSNNEIMIGVMSGGILIYKNRVRMNTFPWLKIVKISFKCKQFFIQLRKELHESRETLLGFNMVNYRACKNLWKACVEHHTFFRLDRPLPPQKNFFAHYFTLGSKFRYCGRTEVQSVQYGKEKANKDRVFARSPSKPLARKLMDWEVVSRNSISDDRLETQSLPSRSPPGTPNHRNSTFTQEGTRLRPSSVGHLVDHMVHTSPSEVFVNQRSPSSTQANSIVLESSPSQETPGDGKPPALPPKQSKKNSWNQIHYSHSQQDLESHINETFDIPSSPEKPTPNGGIPHDNLVLIRMKPDENGRFGFNVKGGYDQKMPVIVSRVAPGTPADLCVPRLNEGDQVVLINGRDIAEHTHDQVVLFIKASCERHSGELMLLVRPNAVYDVVEEKLENEPDFQYIPEKAPLDSVHQDDHSLRESMIQLAEGLITGTVLTQFDQLYRKKPGMTMSCAKLPQNISKNRYRDISPYDATRVILKGNEDYINANYINMEIPSSSIINQYIACQGPLPHTCTDFWQMTWEQGSSMV

SEQ ID NO: 856511 - protein, 883 aa, Homo sapiens
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKRGSPYSLNFRVKFFVSDPNKLQEEYTRYQYFLQIKQDILTGRLPCPSNTAALLASFAVQSELGDYDQSENLSGYLSDYSFIPNQPQDFEKEIAKLHQQHIGLSPAEAEFNYLNTARTLELYGVEFHYARDQSNNEIMIGVMSGGILIYKNRVRMNTFPWLKIVKISFKCKQFFIQLRKELHESRETLLGFNMVNYRACKNLWKACVEHHTFFRLDRPLPPQKNFFAHYFTLGSKFRYCGRTEVQSVQYGKEKANKDRVFARSPSKPLARKLMDWEVVSRNSISDDRLETQSLPSRSPPGTPNHRNSTFTQEGTRLRPSSVGHLVDHMVHTSPSEVFVNQRSPSSTQANSIVLESSPSQETPGDGKPPALPPKQSKKNSWNQIHYSHSQQDLESHINETFDIPSSPEKPTPNGGIPHDNLVLIRMKPDENGRFGFNVKGGYDQKMPVIVSRVAPGTPADLCVPRLNEGDQVVLINGRDIAEHTHDQVVLFIKASCERHSGELMLLVRPNAVYDVVEEKLENEPDFQYIPEKAPLDSVHQDDHSLRESMIQLAEGLITGTVLTQFDQLYRKKPGMTMSCAKLPQNISKNRYRDISPYDATRVILKGNEDYINANYINMEIPSSSIINQYIACQGPLPHTCTDFWQMTWEQGSSMVVMLTTQVERGRVKCHQYWPEPTGSSSYGCYQVTCHSEEGNTAYIFRKMTLFNQEKNESRPLTQIQYIAWPDHGVPDDSSDFLDFVCHVRNKRAGKEEPVVVHCSAGIREDLGLLLQWNRTGRPVRKMAAQQLGI

SEQ ID NO: 856512 - protein, 261 aa, Homo sapiens
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKRGSPYSLNFRVKFFVSDPNKLQEEYTRYQYFLQIKQDILTGRLPCPSNTAALLASFAVQSELGDYDQSENLSGYLSDYSFIPNQPQDFEKEIAKLHQQHIGLSPAEAEFNYLNTARTLELYGVEFHYARDQSNNEIMIGVMSGGILIYKNRVRMNTFPCFFFPHG

SEQ ID NO: 856513 - protein, 926 aa, Homo sapiens; identical to SEQ ID NO: 856507

SEQ ID NO: 856514 - protein, 263 aa, Homo sapiens
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKRGSPYSLNFRVKFFVSDPNKLQEEYTRYQYFLQIKQDILTGRLPCPSNTAALLASFAVQSELGDYDQSENLSGYLSDYSFIPNQPQDFEKEIAKLHQQHIGLSPAEAEFNYLNTARTLELYGVEFHYARDQSNNEIMIGVMSGGILIYKNRVRMNTFPWLKIVKMTF

SEQ ID NO: 856515 - protein, 247 aa, Homo sapiens
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEVCWQPLL

SEQ ID NO: 856516 - protein, 304 aa, Homo sapiens
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEDDFDNDVDALLEEGLCAPKKRRTEEKYGGDSDHPSDGETSVQPMMTKIKTVLKSRGRPPTEPVL

SEQ ID NO: 856517 - protein, 114 aa, Homo sapiens
MQDDFDNDVDALLEEGLCAPKKRRTEEKYGGDSDHPSDGETSVQPMMTKIKTVLKSRGRPPTEPLPDGWIMTFHNSGVPVYLHRESRVVTWSRPYFLGTGSIRVGEASVVTLGL

SEQ ID NO: 856518 - protein, 773 aa, Homo sapiens
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEDDFDNDVDALLEEGLCAPKKRRTEEKYGGDSDHPSDGETSVQPMMTKIKTVLKSRGRPPTEPLPDGWIMTFHNSGVPVYLHRESRVVTWSRPYFLGTGSIRKHDPPLSSIPCLHYKKMKDNEEREQSSDLTPSGDVSPVKPLSRSAELEFPLDEPDSMGADPGPPDEKDPLGAEAAPGALGQVKAKVEVCKDESVDLEEFRSYLEKRFDFEQVTVKKFRTWAERRQFNREMKRKQAESERPILPANQKLITLSVQDAPTKKEFVINPNGKSEVCILHEYMQRVLKVRPVYNFFECENPSEPFGASVTIDGVTYGSGTASSKKLAKNKAARATLEILIPDFVKQTSEEKPKDSEELEYFNHISIEDSRVYELTSKAGLLSPYQILHECLKRNHGMGDTSIKFEVVPGKNQKSEYVMACGKHTVRGWCKNKRVGKQLASQKILQLLHPHVKNWGSLLRMYGRESSKMVKQETSDKSVIELQQYAKKNKPNLHILSKLQEEMKRLAEEREETRKKPKMSIVASAQPGGEPLCTVDV

SEQ ID NO: 856519 - protein, 773 aa, Homo sapiens; identical to SEQ ID NO: 856518

SEQ ID NO: 856520 - protein, 773 aa, Homo sapiens; identical to SEQ ID NO: 856518

SEQ ID NO: 856521 - protein, 280 aa, Homo sapiens
RPTRAVYNFFECETGADLEDTLHVLVQDADLKVRPVYNFFECENPSEPFGASVTIDGVTYGSGTASSKKLAKNKAARATLEILIPDFVKQTSEEKPKDSEELEYFNHISIEDSRVYELTSKAGLLSPYQILHECLKRNHGMGDTSIKFEVVPGKNQKSEYVMACGKHTVRGWCKNKRVGKQLASQKILQLLHPHVKNWGSLLRMYGRESSKMVKQETSDKSVIELQQYAKKNKPNLHILSKLQEEMKRLAEEREETRKKPKMSIVASAQPGGEPLCTVDV

SEQ ID NO: 856522 - protein, 276 aa, Homo sapiens
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 856523 - protein, 328 aa, Homo sapiens
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPGTYGLSNALLETPWRKLCFGKQLFLEAVERSQALPKDVLIASLLDVLNNEEAQLPDPAIEDQGGEYVQPMLSKYAAVCVRCPGYGTRYCSTVGAPPPIPCPTSHARGPAKKPSAHSQSQASSSPEWIPELLPCPDAAAGTNTIILVDADGHVTFTERSMMDKDLSHWETRTYEFTLQS

SEQ ID NO: 856524 - protein, 783 aa, Homo sapiens
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEDDFDNDVDALLEEGLCAPKKRRTEEKYGGDSDHPSDGETSVQPMMTKIKTVLKSRGRPPTEPLPDGWIMTFHNSGVPVYLHRESRVVTWSRPYFLGTGSIRKHDPPLSSIPCLHYKKMKDNEEREQSSDLTPSGDVSPVKPLSRSAELEFPLDEPDSMGADPGPPDEKDPLGAEAAPGALGQVKAKVEVCKDESVDLEEFRSYLEKRFDFEQVTVKKFRTWAERRQFNREMKRKQAESERPILPANQKLITLSVQDAPTKKEFVINPNGKSEVCILHEYMQRVLKVRPVYNFFECENPSEPFGASVTIDGVTYGSGTASSKKLAKNKAARATLEILIPDFVKQTSEEKPKDSEELEYFNHISIEDSRVYELTSKAGLLSPYQILHECLKRNHGMGDTSIKFEVVPGKNQKSEYVMACGKHTVRGWCKNKRVGKQLASQKILQLLHPHVKNWGSLLRMYGRESSKMVKQETSDKSVIELQQYAKKNKPNLHILSKLQEEMKRLAEEREETRKKPKMSIVASAQPGGKQCWPVGRPQHILPSLPV

SEQ ID NO: 856525 - protein, 247 aa, Homo sapiens; identical to SEQ ID NO: 856515

SEQ ID NO: 856526 - protein, 178 aa, Homo sapiens
MAGHQHTWQAGSTHQLPAAAAGLAGPRASTAKGDVICYYGNRGEPDPIVLTPGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 856527 - protein, 109 aa, Homo sapiens
MCIIFFKFDPRPVSKNAYRLILAANRDEFYSRPSKLADFWGNNNEILSGLDMEEGKEGGTWLGISTRGKLAALTNYLQPQLDWQARGRAQQRETSFATMGTEGSLILSF

SEQ ID NO: 856528 - protein, 263 aa, Homo sapiens
MPPKLLCAGRCVGQDGAAQAWHCPPGQGHSVWDAVRMPLGAGTPVNVQRREDSATEGSHRLILAANRDEFYSRPSKLADFWGNNNEILSGLDMEEGKEGGTWLGISTRGKLAALTNYLQPQLDWQARGRGTYGLSNALLETPWRKLCFGKQLFLEAVERSQALPKDVLIASLLDVLNNEEALSGRVLLGQLPDPAIEDQGGEYVQPMLSKYAAVCVRCPGYGTRTNTIILVDADGHVTFTERSMMDKDLSHWETRTYEFTLQS

SEQ ID NO: 856529 - protein, 276 aa, Homo sapiens; identical to SEQ ID NO: 856522

SEQ ID NO: 856530 - protein, 276 aa, Homo sapiens; identical to SEQ ID NO: 856522

SEQ ID NO: 856531 - protein, 700 aa, Homo sapiens
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEDDFDNDVDALLEEGLCAPKKRRTEEKYGGDSDHPSDGETSVQPMMTKIKTVLKSRGRPPTEPLPDGWIMTFHNSGVPVYLHRESRVVTWSRPYFLGTGSIRKHDPPLSSIPCLHYKKMKDNEEREQSSDLTPSGDVSPVKPLSRSAELEFPLDEPDSMGADPGPPDEKDPLGAEAAPGALGQVKAKVEVCKDESVDLEEFRSYLEKRFDFEQVTVKKFRTWAERRQFNREMKRKQAESERPILPANQKLITLSVQDAPTKKEFVINPNGKSEVCILHEYMQRVLKVRPVYNFFECENPSEPFGASVTIDGVTYGSGTASSKKLAKNKAARATLEILIPDFVKQTSEEKPKDSEELEYFNHISIEDSRVYELTSKAGLLSPYQILHECLKRNHGMGDTSIKFEVVPGKNQKSEYVMACGKHTVRGWCKDSFSAAWWPLGGRPLVWPCASVAWSQLLPWHCP

SEQ ID NO: 856532 - protein, 300 aa, Homo sapiens
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEDDFDNDVDALLEEGLCAPKKRRTEEKYGGDSDHPSDGETSVQPMMTKIKTVLKSRGDACL

SEQ ID NO: 856533 - protein, 158 aa, Homo sapiens
QCHLTRVAACYRKPVPEVRVCPVGSGYRSLFWSNDRSRLVFKSGPSSPVATEHRRAWTLDKQTCSCRGDSHIWNWAPRRPEKNPLSLFFFFETESCSVTQAGVQWHDLGSLQPPPPKFKQFSCPSLLISWDYRRVPPCPANFCVFSRDGVSPCWSGWS

SEQ ID NO: 856534 - protein, 180 aa, Homo sapiens
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTGRTPCKDWNSAPRAKASPEAGRGACFRASLRAFRGSRPAVTLIMDFQHPELC

SEQ ID NO: 856535 - protein, 67 aa, Homo sapiens
GSRKSAAVAEAVSARLRGWPTPLVARPAWARGLRALGSGCADRARLLEDLATCVSRAALHHHVHHLL

SEQ ID NO: 856536 - protein, 81 aa, Homo sapiens
LQPAVLSVRCYTSQETSDKSVIELQQYAKKNKPNLHILSKLQEEMKRLAEERVSATLAGGLPGHGHSCGTCGGTADPRTRA

SEQ ID NO: 856537 - protein, 145 aa, Homo sapiens [sequence omitted]

SEQ ID NO: 856538 - protein, 773 aa, Homo sapiens; identical to SEQ ID NO: 856518

SEQ ID NO: 856539 - protein, 773 aa, Homo sapiens; identical to SEQ ID NO: 856518

SEQ ID NO: 856540 - protein, 208 aa, Homo sapiens
SGVVSAAGEGKAATASSGAVGSPARSGGLGGYFNHISIEDSRVYELTSKAGLLSPYQILHECLKRNHGMGDTSIKFEVVPGKNQKSEYVMACGKHTVRGWCKNKRVGKQLASQKILQLLHPHVKNWGSLLRMYGRESSKMVKQETSDKSVIELQQYAKKNKPNLHILSKLQEEMKRLAEEREETRKKPKMSIVASAQPGGEPLCTVDV

SEQ ID NO: 856541 - protein, 276 aa, Homo sapiens; identical to SEQ ID NO: 856522

SEQ ID NO: 856542 - protein, 276 aa, Homo sapiens; identical to SEQ ID NO: 856522

SEQ ID NO: 856543 - protein, 214 aa, Homo sapiens
MCIIFFKFDPRPVSKNAYRLILAANRDEFYSRPSKLADFWGNNNEILSGLDMEEGKEGGTWLGISTRGKLAALTNYLQPQLDWQARGRGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 856544 - protein, 201 aa, Homo sapiens
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLRQLPDPAIEDQGGEYVQPMLSKYAAVCVRCPGYGTRTNTIILVDADGHVTFTERSMMDKDLSHWETRTYEFTLQS

SEQ ID NO: 856545 - protein, 214 aa, Homo sapiens
RKQKIARYGRVCIGRGEAGELVTHFLTTDVDSLSYLKKVSMEGHLYNGFNLIAADLSTAKGDVICYYGNRGEPDPIVLTPGTYGLSNALLETPWRKLCFGKQLFLEAVERSQALPKDVLIASLLDVLNNEEALSGRVLLGQLPDPAIEDQGGEYVQPMLSKYAAVCVRCPGYGTRTNTIILVDADGHVTFTERSMMDKDLSHWETRTYEFTLQS

SEQ ID NO: 856546 - protein, 276 aa, Homo sapiens; identical to SEQ ID NO: 856522

SEQ ID NO: 856547 - protein, 276 aa, Homo sapiens; identical to SEQ ID NO: 856522

SEQ ID NO: 856548 - protein, 352 aa, Homo sapiens [sequence omitted]

SEQ ID NO: 856549 - protein, 109 aa, Homo sapiens; identical to SEQ ID NO: 856527

SEQ ID NO: 856550 - protein, 64 aa, Homo sapiens
MKRREWAGPAGVSPSVPPPGQRERQALLPREAHGSGQAGSPAAGKLMDILSSLPVPLSQLRFPT

SEQ ID NO: 856551 - protein, 191 aa, Homo sapiens
MSNEVETSATNGQPDQRGRTEKHPQEKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQAEPLVVDLDLFVINVKKKEEEKKKIEEASKAVENGSE

SEQ ID NO: 856552 - protein, 109 aa, Homo sapiens
YRCGPLHRRSYALTVFLAAGCADIPSLPKSSCLSLTPTPSTAMVTGLFLPPPSFLELESPGLSKVLRTGAFAYPFLFDNLPLFYRCVKDRICYVGIKGLTEEVLSTWSR

SEQ ID NO: 856553 - protein, 238 aa, Homo sapiens
MSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 856554 - protein, 320 aa, Homo sapiens
MSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 856555 - protein, 211 aa, Homo sapiens
MATISSARCSLASSSPPTCLKGWHQDALITSATATSYSTSVQCWAPTSSWRQCWLIWDHAEPGWPHRNLPWAWQAQWPHWSWLQLGTYSLLLLSQPPCFGPPVHALCCRVAHWRGVPRPNNSEAPSLTLSWRGQRPGPSADEEPRFGPNQVGTHLSLEPTGAEERGHRREGREEEGCLGGLAECERDREGALDGSGRSAEGLRGEMHACPG

SEQ ID NO: 856556 - protein, 176 aa, Homo sapiens
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLVSWSWKALGSVRSSAQEPSPIHSCSTTSHSFIGSGCAGAGATAVGRRP

SEQ ID NO: 856557 - protein, 113 aa, Homo sapiens
MSPRMRHICYFLDYGALSLYSLGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 856558 - protein, 357 aa, Homo sapiens
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRTAMVTGLFLPPPSFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 856559 - protein, 186 aa, Homo sapiens
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRSGCAGAGATAVGRRP

SEQ ID NO: 856560 - protein, 143 aa, Homo sapiens
MSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLARAVLGQGPRLWAGGPEHQPWLPSLLRAAHWLPLRLPPA

SEQ ID NO: 856561 - protein, 230 aa, Homo sapiens
MSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIG

SEQ ID NO: 856562 - protein, 258 aa, Homo sapiens
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGTANS

SEQ ID NO: 856563 - protein, 344 aa, Homo sapiens
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 856564 - protein, 238 aa, Homo sapiens; identical to SEQ ID NO: 856553

SEQ ID NO: 856565 - protein, 211 aa, Homo sapiens; identical to SEQ ID NO: 856555

SEQ ID NO: 856566 - protein, 344 aa, Homo sapiens; identical to SEQ ID NO: 856563

SEQ ID NO: 856567 - protein, 211 aa, Homo sapiens; identical to SEQ ID NO: 856555

SEQ ID NO: 856568 - protein, 344 aa, Homo sapiens; identical to SEQ ID NO: 856563

SEQ ID NO: 856569 - protein, 254 aa, Homo sapiens
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIG

SEQ ID NO: 856570 - protein, 367 aa, Homo sapiens
VDSQMSFENVFSVWNINPIFDNSSRTFGSRASELLWMASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYEVLTFFLLGQEAEKEDKMLALSLEDEHLLYGDIIRQDFLDTYNNLTLKTIMAFRWVTEFCPNAKYVMKTDTDVFINTGNLVKYLLNLNHSEKFFTGYPLIDNYSYRGFYQKTHISYQEYPFKVFPPYCSGLGYIMSRDLVPRIYEMMGHVKPIKFEDVYVGICLNLLKVNIHIPEDTNLFFLYRIHLDVCQLRRVIAAHGFSSKEIITFWQVMLRNTTCHY

SEQ ID NO: 856571 - protein, 319 aa, Homo sapiens
MSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYEVLTFFLLGQEAEKEDKMLALSLEDEHLLYGDIIRQDFLDTYNNLTLKTIMAFRWVTEFCPNAKYVMKTDTDVFINTGNLVKYLLNLNHSEKFFTGYPLIDNYSYRGFYQKTHISYQEYPFKVFPPYCSGLGYIMSRDLVPRIYEMMGHVKPIKFEDVYVGICLNLLKVNIHIPEDTNLFFLYRIHLDVCQLRRVIAAHGFSSKEIITFWQVMLRNTTCHY

SEQ ID NO: 856572 - protein, 319 aa, Homo sapiens; identical to SEQ ID NO: 856571

SEQ ID NO: 856573 - protein, 319 aa, Homo sapiens; identical to SEQ ID NO: 856571

SEQ ID NO: 856574 - protein, 319 aa, Homo sapiens; identical to SEQ ID NO: 856571

SEQ ID NO: 856575 - protein, 319 aa, Homo sapiens; identical to SEQ ID NO: 856571

SEQ ID NO: 856576 - protein, 319 aa, Homo sapiens; identical to SEQ ID NO: 856571

SEQ ID NO: 856577 - protein, 319 aa, Homo sapiens; identical to SEQ ID NO: 856571

SEQ ID NO: 856578 - protein, 319 aa, Homo sapiens; identical to SEQ ID NO: 856571

SEQ ID NO: 856579 - protein, 486 aa, Homo sapiens
KGPGNVVGQGLRAWLDFEGDRPPCCIPFLELLNQVVTGAASWPWEVVPFLTHKNLSQENLVLMSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHTHPTQTAFLSSVDLHTHCSYQMMLPESVAIVCSPKFQETGFFKLTDHGLEEISSCRQKGFHPHSKDPPLFCSCSHVTVVDRAVTITDLR

SEQ ID NO: 856580 - protein, 428 aa, Homo sapiens
VTVSGTSGCHPRGKNLVLMSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHTHPTQTAFLSSVDLHTHCSYQMMLPESVAIVCSPKFQETGFFKLTDHGLEEISSCRQKGFHPHSKDPPLFCPVLQ

SEQ ID NO: 856581 - protein, 535 aa, Homo sapiens
KGPGNVVGQGLRAWLDFEGDRPPCCIPFLELLNQVVTGAASWPWEVVPFLTHKNLSQENLVLMSDHGDVSLPPEDRVRALSQLGSAVEVNEDIPPRRYFRSGVEIIRMASIYSEEGNIEHAFILYNKYITLFIEKLPKHRDYKSAVIPEKKDTVKVGLHFHCCPSKSFRAAQTDFKIKVVVSASEYQILQEEIRPFHHNSSEEQKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHTHPTQTAFLSSVDLHTHCSYQMMLPESVAIVCSPKFQETGFFKLTDHGLEEISSCRQKGFHPHSKDPPLFCSCSHVTVVDRAVTITDLR

SEQ ID NO: 856582 - protein, 405 aa, Homo sapiens
HLFFLSQNLVLMSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHTHPTQTAFLSSVDLHTHCSYQMMLPESVAIVCSPKFQETGFFKLTDHGLEEISSCRQKGFHPHSKDPPLFCSCSHVTVVDRAVTITDLR

SEQ ID NO: 856583 - protein, 486 aa, Homo sapiens; identical to SEQ ID NO: 856579

SEQ ID NO: 856584 - protein, 391 aa, Homo sapiens
VTVSGTSGCHPRGKNLVLMSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHTHPTQTAFLSSVDLHTHCSYQMMLPESVAIVCSPKFQE

SEQ ID NO: 856585 - protein, 442 aa, Homo sapiens
VTVSGTSGCHPRGKNLVLMSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHTHPTQTAFLSSVDLHTHCSYQMMLPESVAIVCSPKFQETGFFKLTDHGLEEISSCRQKGFHPHSKDPPLFCSCSHVTVVDRAVTITDLR

SEQ ID NO: 856586 - protein, 370 aa, Homo sapiens
ERFPEPPGVIRGERLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHTHPTQTAFLSSVDLHTHCSYQMMLPESVAIVCSPKFQETGFFKLTDHGLEEISSCRQKGFHPHSKDPPLFCSCSHVTVVDRAVTITDLR

SEQ ID NO: 856587 - protein, 289 aa, Homo sapiens
MAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHTHPTQTAFLSSVDLHTHCSYQMMLPESVAIVCSPKFQETGFFKLTDHGLEEISSCRQKGFHPHSKDPPLFCSCSHVTVVDRAVTITDLR

SEQ ID NO: 856588 - protein, 442 aa, Homo sapiens; identical to SEQ ID NO: 856585

SEQ ID NO: 856589 - protein, 211 aa, Homo sapiens
KGPGNVVGQGLRAWLDFEGDRPPCCIPFLELLNQVVTGAASWPWEVVPFLTHKNLSQENLVLMSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKGAGVAPDRSRPEQKSTGSSRSP

SEQ ID NO: 856590 - protein, 196 aa, Homo sapiens
LTAAGGPGVMGGLFWRSALRGLRCGPRAPGPSLLVRHGSGGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 856591 - protein, 196 aa, Homo sapiens; identical to SEQ ID NO: 856590

SEQ ID NO: 856592 - protein, 117 aa, Homo sapiens
MKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 856593 - protein, 146 aa, Homo sapiens
LTAAGRAGRHGRPLLALRAAGAALRPAGPGPEPASAPRLGVPSRGGRLGRSSALTLGLEATGLETPQQHRPRLLARTEPCYLPSSIFRPLFVRVSRAHRLVGKVCFSLVPCHSFTSDTGWALGSSSCGKSGLQTMSVVIQKGWSQK

SEQ ID NO: 856594 - protein, 196 aa, Homo sapiens; identical to SEQ ID NO: 856590

SEQ ID NO: 856595 - protein, 196 aa, Homo sapiens; identical to SEQ ID NO: 856590

SEQ ID NO: 856596 - protein, 117 aa, Homo sapiens; identical to SEQ ID NO: 856592

SEQ ID NO: 856597 - protein, 117 aa, Homo sapiens; identical to SEQ ID NO: 856592

SEQ ID NO: 856598 - protein, 145 aa, Homo sapiens
MKMLQVPEVRASQLLCQCPRLLSAAPPYLNATQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 856599 - protein, 153 aa, Homo sapiens
MKMLQAPESVLAEHYQDLRRKPFYPALIRYMSSGPVVAMVWEGYNVVRASRAMIGHTDSAEAAPGTIRGDFSVHISSHRLAPLDRGQREQQMVPGFLRVHMKPEPHIAPVLAQNVIHASDSVEGAQREIQLWFQSSELVSWADGGQHSSIHPA

SEQ ID NO: 856600 - protein, 176 aa, Homo sapiens
MKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELDQLPPSARTQAHIQTCLSQTTYFPVHLCPTPAQRSLSHQLQCLSVPQASTRLDQSFLHQSAGQPLWWGGVFTLS

SEQ ID NO: 856601 - protein, 120 aa, Homo sapiens
MKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELGQSGLHHRRRLWDWVPDC

SEQ ID NO: 856602 - protein, 196 aa, Homo sapiens; identical to SEQ ID NO: 856590

SEQ ID NO: 856603 - protein, 268 aa, Homo sapiens
LTAAGGPGVMGGLFWRSALRGLRCGPRAPGPSLLVRHGSGGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELSPTGSAMAQPPPDVEGDDCLPAYRHLFCPDLLRDKVAFITGGGSGIGFRIAEIFMRHGCHTVIASRSLPRVLTRWVFTTLTRLVSNS

SEQ ID NO: 856604 - protein, 97 aa, Homo sapiens
PRPLPPVVPAVPDGSAMAQPPPDVEGDDCLPAYRHLFCPDLLRDKVAFITGGGSGIGFRIAEIFMRHGCHTVIASRSLPRVLTRWVFTTLTRLVSNS

SEQ ID NO: 856605 - protein, 196 aa, Homo sapiens; identical to SEQ ID NO: 856590

SEQ ID NO: 856606 - protein, 255 aa, Homo sapiens
LTAAGRAGRHGRPLLALRAAGAALRPAGPGPEPASAPRLGVPSRGGRLGRSSALTLGLEATGLETPQQHRPRLLARTEPCYLPSSIFRPLFVRVSRAHRGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 856607 - protein, 117 aa, Homo sapiens; identical to SEQ ID NO: 856592

SEQ ID NO: 856608 - protein, 232 aa, Homo sapiens
SQRPGGPGVMGGLFWRSALRGLRCGPRAPGPSLLVRHGSGGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISSHRLAPLDRGQREQQMVPGFLRVHMKPEPHIAPVLAQNVIHASDSVEGAQREIQLWFQSSELVSWADGGQHSSIHPA

SEQ ID NO: 856609 - protein, 144 aa, Homo sapiens
MKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSNSMQTIQKTTTRRIVDGKVVSETNDTKVLRH

SEQ ID NO: 856610 - protein, 143 aa, Homo sapiens
MKMLQAPESVLAEHYQDLRRKPFYPALIRYMSSGPVVAMVWEGYNVVRASRAMIGHTDSAEAAPGTIRGDFSVHISRTQAHIQTCLSQTTYFPVHLCPTPAQRSLSHQLQCLSVPQASTRLDQSFLHQSAGQPLWWGGVFTLS

SEQ ID NO: 856611 - protein, 148 aa, Homo sapiens
RASGLRRALAAAERPVRGSGAPPQSFCSAGIGFLDKQALTIIPKQEFKNVFRNSNDMDGKDALLHDASGGPHFPFRDTLSTQLMLHTRPTPVPTLTECRLERDADFRGGVFFGLNVFPKKGIFGLMKAKPVLPSPRVRKSQGYKQLDH

SEQ ID NO: 856612 - protein, 289 aa, Homo sapiens
MEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAASASLTPDFLSPGSSNVSSPLPCFGSSFHSTTSFVISDITEETEVEVPELPSVPLLCSASPECCKPEHKAACSSSEEDDCVSLSKASSFADMMGILKDFHRMKQSQDLNRSLLKEEDPAVLISEVLRRKFALKEEDISRKGN

SEQ ID NO: 856613 - protein, 289 aa, Homo sapiens; identical to SEQ ID NO: 856612

SEQ ID NO: 856614 - protein, 422 aa, Homo sapiens
PAPLFRFPGRRQPPPAAAMGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSTPAASYEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSC

SEQ ID NO: 856615 - protein, 213 aa, Homo sapiens
MRSCRRLDFVKTRFAPQVAGGWLIDHQRLLLHGDVRIDAESSSAESVRVPLRFSSMSHVTAGQIMPLTQLGRASHVRYLLGSSVPKALRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSC

SEQ ID NO: 856616 - protein, 289 aa, Homo sapiens; identical to SEQ ID NO: 856612

SEQ ID NO: 856617 - protein, 289 aa, Homo sapiens; identical to SEQ ID NO: 856612

SEQ ID NO: 856618 - protein, 445 aa, Homo sapiens
PAPLFRFPGRRQPPPAAAMGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSTPAASYEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSC

SEQ ID NO: 856619 - protein, 289 aa, Homo sapiens; identical to SEQ ID NO: 856612

SEQ ID NO: 856620 - protein, 289 aa, Homo sapiens; identical to SEQ ID NO: 856612

SEQ ID NO: 856621 - protein, 202 aa, Homo sapiens
MEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAVTSPRRQRWRSLSFHQSPCFVLPALNVANQNTKLPAVRLKRMTASLCPRPAALQT

SEQ ID NO: 856622 - protein, 195 aa, Homo sapiens
MQRNASVPNLRGSEERLLALKKPALPALSRTTELQDELSHLRSQIAKIVAADAASASLTPDFLSPGSSNVSSPLPCFGSSFHSTTSFVISDITEETEVEVPELPSVPLLCSASPECCKPEHKAACSSSEEDDCVSLSKASSFADMMGILKDFHRMKQSQDLNRSLLKEEDPAVLISEVLRRKFALKEEDISRKGN

SEQ ID NO: 856623 - protein, 289 aa, Homo sapiens; identical to SEQ ID NO: 856612

SEQ ID NO: 856624 - protein, 195 aa, Homo sapiens; identical to SEQ ID NO: 856622

SEQ ID NO: 856625 - protein, 195 aa, Homo sapiens; identical to SEQ ID NO: 856622

SEQ ID NO: 856626 - protein, 445 aa, Homo sapiens; identical to SEQ ID NO: 856618

SEQ ID NO: 856627 - protein, 445 aa, Homo sapiens; identical to SEQ ID NO: 856618

SEQ ID NO: 856628 - protein, 103 aa, Homo sapiens
GEGTLEHSGLLSLTDLLGFPWSRSDTRPLRHTWKPSPLIVMQRNASVPNLRGSEERLLALKKPALPALSRTTELQDELSHLRSQIAKIVAADAGRSPCARART

SEQ ID NO: 856629 - protein, 479 aa, Homo sapiens
PAPLFRFPGRRQPPPAAAMGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSCSVTQTGVQWCSHSSLQPQLPWLNGSSCLSLLRSTPAASYEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSC

SEQ ID NO: 856630 - protein, 445 aa, Homo sapiens; identical to SEQ ID NO: 856618

SEQ ID NO: 856631 - protein, 292 aa, Homo sapiens
MTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSC

SEQ ID NO: 856632 - protein, 289 aa, Homo sapiens; identical to SEQ ID NO: 856612

SEQ ID NO: 856633 - protein, 445 aa, Homo sapiens; identical to SEQ ID NO: 856618

SEQ ID NO: 856634 - protein, 445 aa, Homo sapiens; identical to SEQ ID NO: 856618

SEQ ID NO: 856635 - protein, 289 aa, Homo sapiens; identical to SEQ ID NO: 856612

SEQ ID NO: 856636 - protein, 445 aa, Homo sapiens; identical to SEQ ID NO: 856618

SEQ ID NO: 856637 - protein, 445 aa, Homo sapiens; identical to SEQ ID NO: 856618

SEQ ID NO: 856638 - protein, 195 aa, Homo sapiens; identical to SEQ ID NO: 856622

SEQ ID NO: 856639 - protein, 195 aa, Homo sapiens; identical to SEQ ID NO: 856622

SEQ ID NO: 856640 - protein, 231 aa, Homo sapiens
MCPQSLPWLTSPGLLRMKRSDTRPLRHTWKPSPLIVMQRNASVPNLRGSEERLLALKKPALPALSRTTELQDELSHLRSQIAKIVAADAASASLTPDFLSPGSSNVSSPLPCFGSSFHSTTSFVISDITEETEVEVPELPSVPLLCSASPECCKPEHKAACSSSEEDDCVSLSKASSFADMMGILKDFHRMKQSQDLNRSLLKEEDPAVLISEVLRRKFALKEEDISRKGN

SEQ ID NO: 856641 - protein, 445 aa, Homo sapiens; identical to SEQ ID NO: 856618

SEQ ID NO: 856642 - protein, 445 aa, Homo sapiens; identical to SEQ ID NO: 856618

SEQ ID NO: 856643 - protein, 444 aa, Homo sapiens
RRPRRGAPSPAAMPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 856644 - protein, 304 aa, Homo sapiens
LRLGTRLGGGLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 856645 - protein, 306 aa, Homo sapiens
MIDFGVFQGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 856646 - protein, 303 aa, Homo sapiens
RRPRRGAPSPAAMPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVRLHFLVLRILHLLTPSG

SEQ ID NO: 856647 - protein, 427 aa, Homo sapiens
RRPRRGAPSPAAMPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKMESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 856648 - protein, 444 aa, Homo sapiens; identical to SEQ ID NO: 856643

SEQ ID NO: 856649 - protein, 444 aa, Homo sapiens; identical to SEQ ID NO: 856643

SEQ ID NO: 856650 - protein, 444 aa, Homo sapiens; identical to SEQ ID NO: 856643

SEQ ID NO: 856651 - protein, 444 aa, Homo sapiens; identical to SEQ ID NO: 856643

SEQ ID NO: 856652 - protein, 444 aa, Homo sapiens; identical to SEQ ID NO: 856643

SEQ ID NO: 856653 - protein, 206 aa, Homo sapiens
RRPRRGAPSPAAMPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPEQGHCVGTH

SEQ ID NO: 856654 - protein, 444 aa, Homo sapiens; identical to SEQ ID NO: 856643

SEQ ID NO: 856655 - protein, 444 aa, Homo sapiens; identical to SEQ ID NO: 856643

SEQ ID NO: 856656 - protein, 444 aa, Homo sapiens; identical to SEQ ID NO: 856643

SEQ ID NO: 856657 - protein, 444 aa, Homo sapiens; identical to SEQ ID NO: 856643

SEQ ID NO: 856658 - protein, 444 aa, Homo sapiens; identical to SEQ ID NO: 856643

SEQ ID NO: 856659 - protein, 410 aa, Homo sapiens
RRPRRGAPSPAAMPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKRIPGLGGSEREKRREGIAAVRDGPGCSEREKQG

SEQ ID NO: 856660 - protein, 262 aa, Homo sapiens
RRPRRGAPSPAAMPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVSESPY

SEQ ID NO: 856661 - protein, 248 aa, Homo sapiens
RRPRRGAPSPAAMPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGKGDVLMPASENHYYSLACWAFPSCYSRALR

SEQ ID NO: 856662 - protein, 134 aa, Homo sapiens
GTRSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRQPSIWQV

SEQ ID NO: 856663 - protein, 416 aa, Homo sapiens
RRPRRGAPSPAAMPARPGRLLPLLARPAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 856664 - protein, 269 aa, Homo sapiens
MLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 856665 - protein, 444 aa, Homo sapiens; identical to SEQ ID NO: 856643

SEQ ID NO: 856666 - protein, 444 aa, Homo sapiens; identical to SEQ ID NO: 856643

SEQ ID NO: 856667 - protein, 444 aa, Homo sapiens; identical to SEQ ID NO: 856643

SEQ ID NO: 856668 - protein, 444 aa, Homo sapiens; identical to SEQ ID NO: 856643

SEQ ID NO: 856669 - protein, 444 aa, Homo sapiens; identical to SEQ ID NO: 856643

SEQ ID NO: 856670 - protein, 162 aa, Homo sapiens
STTTPGLSEESTTVYSSSPGSTETTVFPRSTTTSVRGEEPTTFHSRPASTHTTLFTEDSTTSGLTEESTAKPQRAELHWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 856671 - protein, 444 aa, Homo sapiens; identical to SEQ ID NO: 856643

SEQ ID NO: 856672 - protein, 444 aa, Homo sapiens; identical to SEQ ID NO: 856643

SEQ ID NO: 856673 - protein, 68 aa, Homo sapiens
VGAMALVGAMALVGRYGLVWALMALVGAMALVGAMALVGAMALVGAMALVAALALVCTAVAAVDASVL

SEQ ID NO: 856674 - protein, 444 aa, Homo sapiens; identical to SEQ ID NO: 856643

SEQ ID NO: 856675 - protein, 439 aa, Homo sapiens
RRPRRGAPSPAAMPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPYCSWVGPGKPGHCERTSKRILVWGGKTEKRAQNESSPPYEKDLYFFLSDITCALGNLTTVTHKLRRESLSPTIVEITPD

SEQ ID NO: 856676 - protein, 146 aa, Homo sapiens
RRPRRGAPSPAAMPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVANSPASQRTPGKRPSSGQ

SEQ ID NO: 856677 - protein, 211 aa, Homo sapiens
MAQAKINAKANEGRFCRSSSMADRSSRLLESLDQLELRVEALREAATAVEQEKEILLEMIHSIQNSQDMRQISDGEREELNLTANRLMGRTLTVEVSVETIRNPQQQESLKHATRIIDEVVNKFLDDLGNAKSHLMSLYSACSSEVPHGPVDQKFQSIVIGCALEDQKKIKRRLETLLRNIENSDKAIKLLEHSKGAGSKTLQQNAESRFN

SEQ ID NO: 856678 - protein, 211 aa, Homo sapiens; identical to SEQ ID NO: 856677

SEQ ID NO: 856679 - protein, 178 aa, Homo sapiens
MPHMWVEALREAATAVEQEKEILLEMIHSIQNSQDMRQISDGEREELNLTANRLMGRTLTVEVSVETIRNPQQQESLKHATRIIDEVVNKFLDDLGNAKSHLMSLYSACSSEVPHGPVDQKFQSIVIGCALEDQKKIKRRLETLLRNIENSDKAIKLLEHSKGAGSKTLQQNAESRFN

SEQ ID NO: 856680 - protein, 178 aa, Homo sapiens; identical to SEQ ID NO: 856679

SEQ ID NO: 856681 - protein, 160 aa, Homo sapiens
MPHMWVEALREAATAVEQEKEILLEMIHSILTANRLMGRTLTVEVSVETIRNPQQQESLKHATRIIDEVVNKFLDDLGNAKSHLMSLYSACSSEVPHGPVDQKFQSIVIGCALEDQKKIKRRLETLLRNIENSDKAIKLLEHSKGAGSKTLQQNAESRFN

SEQ ID NO: 856682 - protein, 211 aa, Homo sapiens; identical to SEQ ID NO: 856677

SEQ ID NO: 856683 - protein, 153 aa, Homo sapiens
MIHSIQNSQDMRQISDGEREELNLTANRLMGRTLTVEVSVETIRNPQQQESLKHATRIIDEVVNKFLDDLGNAKSHLMSLYSACSSEVPHGPVDQKFQSIVIGCALEDQKKIKRRLETLLRNIENSDKAIKLLEHSKGAGSKTLQQNAESRFN

SEQ ID NO: 856684 - protein, 104 aa, Homo sapiens
MEAYDQKIAEEEAKAKEEEGVPDEEGWVKVTRRGRRPVLPRTEAASLRVLERERRKRSRKELLNFYAWQHRESKMEHLAQLRKKFEEDKQRIELLRAQRKFRPY

SEQ ID NO: 856685 - protein, 104 aa, Homo sapiens; identical to SEQ ID NO: 856684

SEQ ID NO: 856686 - protein, 104 aa, Homo sapiens; identical to SEQ ID NO: 856684

SEQ ID NO: 856687 - protein, 104 aa, Homo sapiens; identical to SEQ ID NO: 856684

SEQ ID NO: 856688 - protein, 104 aa, Homo sapiens; identical to SEQ ID NO: 856684

SEQ ID NO: 856689 - protein, 253 aa, Homo sapiens
EERGERTARYEAWVARSRVARWWRAGGSAPRGTRRTVSPAHWATQESLSRLLSTCGLVQSVELQEKPDLAESPKESRSKFFHPKPVPGFQVAYVVFQKPSGVSAALALKGPLLVSTESHPVKSGIHKWISDYADSVPDPEALRVEVDTFMEAYDQKIAEEEAKAKEEEGVPDEEGWVKVTRRGRRPVLPRTEAASLRVLERERRKRSRKELLNFYAWQHRESKMEHLAQLRKKFEEDKQRIELLRAQRKFRPY

SEQ ID NO: 856690 - protein, 103 aa, Homo sapiens
MEAYDQKIAEEEAKAKEEEGVPDEEGWVKVTRRGRRPVLPRTEAASLRVLERERRKRSQKELLNYAWQHRESKMEHLAQLRKKFEEDKQRIELLRAQRKFRPY

SEQ ID NO: 856691 - protein, 257 aa, Homo sapiens
MVARRRKCAARDPEDRIPSPLGYAAIPIKFSEKQQASHYLYVRAHGVRQGTKSTWPQKRTLFVLNVPPYCTSRSEAMVPTVSRLGQMWLWLSPSAALDPWQRHPWCREALGWPCGCSHLASLSLRQESLSRLLSTCGLVQSVELQEKPDLAESPKESRSKFFHPKPVPGFQVAYVVFQKPSGVSAALALKGPLLVSTESHPVKSGIHKWISDYADSVPDPEALRVEVDTFMEAYDQKIAEEEAKGKRGGSRCLGVRF

SEQ ID NO: 856692 - protein, 103 aa, Homo sapiens; identical to SEQ ID NO: 856690

SEQ ID NO: 856693 - protein, 104 aa, Homo sapiens; identical to SEQ ID NO: 856684

SEQ ID NO: 856694 - protein, 104 aa, Homo sapiens; identical to SEQ ID NO: 856684

SEQ ID NO: 856695 - protein, 104 aa, Homo sapiens; identical to SEQ ID NO: 856684

SEQ ID NO: 856696 - protein, 99 aa, Homo sapiens
RRPPRALPGGKMVARRRKCAARDPEDRIPSPLGYAAIPIKFSEKQQASHYLYVRAHGVRQGTKSTWPQKRTLFVLNVPPYCTSRRACPASCPPVASSSL

SEQ ID NO: 856697 - protein, 126 aa, Homo sapiens
MSVMDLANTCSSFQSDLDFCSDCGSVLPLPGAQDTVTCIRCGFNINVRDFEGKVVKTSVVFHQLGTAMPMSVEEGPECQGPVVDRRCPRCGHEGMAYHTRQMRSADEGQTVFYTCTNCKFQEKEDS

SEQ ID NO: 856698 - protein, 88 aa, Homo sapiens
FAAASTTAREDDRRANCLLHLYQLQVPGEGRLLTFFLGNSTVPPSFRKVKDTGFLDALSILSGCNVLLPEENQIIMWGLPLFLEYSYP

SEQ ID NO: 856699 - protein, 126 aa, Homo sapiens; identical to SEQ ID NO: 856697

SEQ ID NO: 856700 - protein, 110 aa, Homo sapiens
MTRICSVHRTDVNAPSACRAQIRHIAVLTHVRDFEGKVVKTSVVFHQLGTAMPMSVEEGPECQGPVVDRRCPRCGHEGMAYHTRQMRSADEGQTVFYTCTNCKFQEKEDS

SEQ ID NO: 856701 - protein, 66 aa, Homo sapiens
RWELKQRRWKKLHKAREITAGGKSMMGSRVLRTGKLLEAAGAGPGSPALAVFAFGRGQSLLFQVPA

SEQ ID NO: 856702 - protein, 45 aa, Homo sapiens
MVQTGLWPCFRSYGRSSPLSATSLDSCRRRKQQEQEEAGEGGRRR

SEQ ID NO: 856703 - protein, 526 aa, Homo sapiens
AAASSPGVQSPVAPPRYSVNHWESGSMEAARPPPTAGKFVVVGGGIAGVTCAEQLATHFPSEDILLVTASPVIKAVTNFKQISKILEEFDVEEQSSTMLGKRFPNIKVIESGVKQLKSEEHCIVTEDGNQHVYKKLCLCAGAKPKLICEGNPYVLGIRDTDSAQEFQKQLTKAKRIMIIGNGGIALELVYEIEGCEVIWAIKDKAIGNTFFDAGAAEFLTSKLIAEKSEAKIAHKRTRYTTEGRKKEARSKSKADNVGSALGPDWHEGLNLKGTKEFSHKIHLETMCEVKKIYLQDEFRILKKKSFTFPRDHKSVTADTEMWPVYVELTNEKIYGCDFIVSATGVTPNVEPFLHGNSFDLGEDGGLKVDDHMHTSLPDIYAAGDICTTSWQLSPVWQQMRLWTQARQMGWYAAKCMAAASSGDSIDMDFSFELFAHVTKFFNYKVVLLGKYNAQGLGSDHELMLRCTKGREYIKVVMQNGRMMGAVLIGETDLEETFENLILNQMNLSSYGEDLLDPNIDIEDYFD

SEQ ID NO: 856704 - protein, 139 aa, Homo sapiens [sequence omitted]

SEQ ID NO: 856705 - protein, 285 aa, Homo sapiens
AAASSPGVQSPVAPPRYSVNHWESGSMEAARPPPTAGKFVVVGGGIAGVTCAEQLATHFPSEDILLVTASPVIKAVTNFKQISKILEEFDVEEQSSTMLGKRFPNIKVIESGVKQLKSEEHCIVTEDGNQHVYKKLCLCAGAKPKLICEGNPYVLGIRDTDSAQEFQKQLTKAKRIMIIGNGGIALELVYEIEGCEVIWAIKDKAIGNTFFDAGAAEFLTSKLIAEKSEAKIAHKRTRYTTEGRKKEARSKSKADNVGSALGPDWHEGLNLKGTKEQYSQHPHQK

SEQ ID NO: 856706 - protein, 359 aa, Homo sapiens
AAASSPGVQSPVAPPRYSVNHWESGSMEAARPPPTAGKFVVVGGGIAGVTCAEQLATHFPSEDILLVTASPVIKAVTNFKQISKILEEFDVEEQSSTMLGKRFPNIKVIESGVKQLKSEEHCIVTEDGNQHVYKKLCLCAGAKPKLICEGNPYVLGIRDTDSAQEFQKQLTKAKRIMIIGNGGIALELVYEIEGCEVIWAIKDKAIGNTFFDAGAAEFLTSKLIAEKSEAKIAHKRTRYTTEGRKKEARSKSKADNVGSALGPDWHEGLNLKGTKEFSHKIHLETMCEVKKIYLQDEFRILKKKSFTFPRDHKSVTADTEMWPVYVELTNEKIYGCDFIVSATGVTPNVEPFLHGNSVR

SEQ ID NO: 856707 - protein, 745 aa, Homo sapiens
MSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 856708 - protein, 824 aa, Homo sapiens
PLLSGWRGGFGSSGRRRPEGVCWAKPEAEEDDCFTDPVIGPSFSPFPPSLPPLSRRGAAAALDFAVFPRGDRFQHYTCTMSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 856709 - protein, 824 aa, Homo sapiens; identical to SEQ ID NO: 856708

SEQ ID NO: 856710 - protein, 764 aa, Homo sapiens
MYRVTWSTFWLRFQHYTCTMSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 856711 - protein, 745 aa, Homo sapiens; identical to SEQ ID NO: 856707

SEQ ID NO: 856712 - protein, 808 aa, Homo sapiens
MTGKKGEKLRWQRTWTKTHGDMERKPCDIERKSTGQLIGENGTLLYPDCGDGHAWLFQHYTCTMSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 856713 - protein, 745 aa, Homo sapiens; identical to SEQ ID NO: 856707

SEQ ID NO: 856714 - protein, 808 aa, Homo sapiens
PLLSGWRGGFGSSGRRRPEGVCWAKPEAEEDDCFTDPVIGPSFSPFPPSLPPLSRRGAAAALDFAVFPRGDRFQHYTCTMSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 856715 - protein, 104 aa, Homo sapiens
MNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 856716 - protein, 784 aa, Homo sapiens
PLLSGWRGGFGSSGRRRPEGVCWAKPEAEEDDCFTDPVIGPSFSPFPPSLPPLSRRGAAAALDFAVFPRGDRFQHYTCTMSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTKSAADVERITYGQQQIVRIIKARRVPRREPYSTKMIS

SEQ ID NO: 856717 - protein, 136 aa, Homo sapiens
GSGPCRGGGAGTARGGRARAGARRAGEARSLRAPFARSFPPPSAAAAAAAAASAHLPRRGFVFHSFGLPPPPLVPCPLPCFCRRALTRKPCHPLDWIPGLPNPILAASPAAPFSFEGGKISTLHLHNVFETKSSRF

SEQ ID NO: 856718 - protein, 71 aa, Homo sapiens
PCRPRTKSSAAADRTASSRPVLPSPTPGRPPGGGPEEKNPGSNSAPCRPPAGVKRHNPTMKWNRGGAAGRL

SEQ ID NO: 856719 - protein, 177 aa, Homo sapiens
LNPTQPIHQGMSMLKYMFYDVWMRGHLTLSSYHLRLANPLASEYSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQS

SEQ ID NO: 856720 - protein, 824 aa, Homo sapiens; identical to SEQ ID NO: 856708

SEQ ID NO: 856721 - protein, 745 aa, Homo sapiens; identical to SEQ ID NO: 856707

SEQ ID NO: 856722 - protein, 808 aa, Homo sapiens; identical to SEQ ID NO: 856712

SEQ ID NO: 856723 - protein, 745 aa, Homo sapiens; identical to SEQ ID NO: 856707

SEQ ID NO: 856724 - protein, 824 aa, Homo sapiens; identical to SEQ ID NO: 856708

SEQ ID NO: 856725 - protein, 752 aa, Homo sapiens
PLLSGWRGGFGSSGRRRPEGVCWAKPEAEEDDCFTDPVIGPSFSPFPPSLPPLSRRGAAAALDFAVFPRGDRFQHYTCTMSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEYEPTLNSLM

SEQ ID NO: 856726 - protein, 71 aa, Homo sapiens; identical to SEQ ID NO: 856718

SEQ ID NO: 856727 - protein, 947 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856728 - protein, 175 aa, Homo sapiens
RPSSLFLPSLHLLAPEFCFFIVKVIGSSVSVSPSQVWDVFHHKDQWPQPMNPSLCLHFIPLPPLWCCPAQIPAFAPGLPGCEGSAQQPWQGHQLESLPHCSPVSPLLPWPLKLSSLSCQPQKLKPVDYEYREEVHWATHQLRLGRGSFGEVHRMEDKQTGFQCAVKKVRQGSGAE

SEQ ID NO: 856729 - protein, 926 aa, Homo sapiens
PSSCFLVLNMQICPFCDSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856730 - protein, 948 aa, Homo sapiens
KFLFFLLSANPTPFALGENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856731 - protein, 446 aa, Homo sapiens
TRHDSPVPLPPRGGLAADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856732 - protein, 356 aa, Homo sapiens
QEMREGRPHLLSFAPQIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856733 - protein, 970 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQVRGAGTL

SEQ ID NO: 856734 - protein, 897 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKVSRLWPRSHGSRGVVF

SEQ ID NO: 856735 - protein, 744 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQGRKSPTLADPGGRRQRW

SEQ ID NO: 856736 - protein, 638 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGKAPHQLPCPPMHSFA

SEQ ID NO: 856737 - protein, 438 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRQGSGAE

SEQ ID NO: 856738 - protein, 109 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYR

SEQ ID NO: 856739 - protein, 102 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECRGLGLLWARGRWVGLQ

SEQ ID NO: 856740 - protein, 177 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLGNIARSHVYKRVKNRNKKEISKV

SEQ ID NO: 856741 - protein, 1017 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856742 - protein, 483 aa, Homo sapiens
MYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856743 - protein, 855 aa, Homo sapiens
CPWALALCADELCFPPQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856744 - protein, 754 aa, Homo sapiens
RPSSLFLPSLHLLAPEFCFFIVKVIGSSVSVSPSQVWDVFHHKDQWPQPMNPSLCLHFIPLPPLWCCPAQIPAFAPGLPGCEGSAQQPWQGHQLESLPHCSPVSPLLPWPLKLSSLSCQPQKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856745 - protein, 152 aa, Homo sapiens
ILEPRALSPYPILLFQNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856746 - protein, 104 aa, Homo sapiens
WGASSRSPDYHLVRLLGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 856747 - protein, 1017 aa, Homo sapiens; identical to SEQ ID NO: 856741

SEQ ID NO: 856748 - protein, 945 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGTVQFPPAQQSPWQLI

SEQ ID NO: 856749 - protein, 491 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPP

SEQ ID NO: 856750 - protein, 693 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGKEPGPTLSPNSGPRVPPWVLPKLALVTDLSIVNLLTLLTLLSTACPVLLPLAGMEARASPMYSLAFGLLGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKVGDGTQHGQQGELQGP

SEQ ID NO: 856751 - protein, 400 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEVTNPPAPVYVPLPATW

SEQ ID NO: 856752 - protein, 194 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQVRPSTHCPDPRFMGP

SEQ ID NO: 856753 - protein, 134 aa, Homo sapiens
RERALCGTGNRPLWRGGASRARRGGDPAKDNKSSLIKMSSAPEPPTFKKEPPKEKEFQSPGLRGVRTTTLFRAVNPELFIKPNKPVMAFGLVTLSLCVAYIGYLHAIQENKKDLYEAIDSEGHSYMRRKTSKWD

SEQ ID NO: 856754 - protein, 134 aa, Homo sapiens; identical to SEQ ID NO: 856753

SEQ ID NO: 856755 - protein, 99 aa, Homo sapiens
SPAPLPTSRSSLRFRSRLPLSSAPVTPTLPHLSRPSPPPPRYPTPPRLVPCTHASHTRPIRSLAPSGIPRGKSTIFVPTRRFPVLSPRQRGFFPHPPAP

SEQ ID NO: 856756 - protein, 134 aa, Homo sapiens; identical to SEQ ID NO: 856753

SEQ ID NO: 856757 - protein, 134 aa, Homo sapiens; identical to SEQ ID NO: 856753

SEQ ID NO: 856758 - protein, 134 aa, Homo sapiens; identical to SEQ ID NO: 856753

SEQ ID NO: 856759 - protein, 134 aa, Homo sapiens; identical to SEQ ID NO: 856753

SEQ ID NO: 856760 - protein, 212 aa, Homo sapiens
LSAILTSSSLSSPFPSSATGYRLPTTPPPHPPPALAAPHCPATTPILVPHRNCTRLNPHNVFARHGIPPVASQTFLPKSPPMLYARRAGLCTTVRTNRHYFLITTGPDNKSSLIKMSSAPEPPTFKKEPPKEKEFQSPGLRGVRTTTLFRAVNPELFIKPNKPVMAFGLVTLSLCVAYIGYLHAIQENKKDLYEAIDSEGHSYMRRKTSKWD

SEQ ID NO: 856761 - protein, 113 aa, Homo sapiens
RERALCGTGNRPLWRGGASRARRGGDPAKDNKSSLIKMSSAPEPPTFKKEPPKEKEFQSPGLRGVRTTTLFRAVNPELFIKPNVSYSLKHQHFEVSFMEVGTEMGVKMSVNKA

SEQ ID NO: 856762 - protein, 1675 aa, Homo sapiens
TAAAAAGGAIAAAVAATGRGAAVGDRGRGCRRRSGWKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856763 - protein, 1604 aa, Homo sapiens
TAAAAAGGAIAAAVAATGRGAAVGDRGRGCRRRSGWKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856764 - protein, 1634 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856765 - protein, 1634 aa, Homo sapiens; identical to SEQ ID NO: 856764

SEQ ID NO: 856766 - protein, 1675 aa, Homo sapiens; identical to SEQ ID NO: 856762

SEQ ID NO: 856767 - protein, 1650 aa, Homo sapiens
TAAAAAGGAIAAAVAATGRGAAVGDRGRGCRRRSGWKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856768 - protein, 1644 aa, Homo sapiens
TAAAAAGGAIAAAVAATGRGAAVGDRGRGCRRRSGWKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYPARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856769 - protein, 1623 aa, Homo sapiens
TAAAAAGGAIAAAVAATGRGAAVGDRGRGCRRRSGWKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856770 - protein, 983 aa, Homo sapiens
RPLQHQNGQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856771 - protein, 1551 aa, Homo sapiens
TAAAAAGGAIAAAVAATGRGAAVGDRGRGCRRRSGWKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVSLPV

SEQ ID NO: 856772 - protein, 1530 aa, Homo sapiens
TAAAAAGGAIAAAVAATGRGAAVGDRGRGCRRRSGWKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGKNRS

SEQ ID NO: 856773 - protein, 1730 aa, Homo sapiens
TAAAAAGGAIAAAVAATGRGAAVGDRGRGCRRRSGWKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856774 - protein, 107 aa, Homo sapiens
MSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGKNRS

SEQ ID NO: 856775 - protein, 1373 aa, Homo sapiens
TAAAAAGGAIAAAVAATGRGAAVGDRGRGCRRRSGWKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVILPQSLPKAVQRRKAPNGKST

SEQ ID NO: 856776 - protein, 1643 aa, Homo sapiens
TAAAAAGGAIAAAVAATGRGAAVGDRGRGCRRRSGWKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMSNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856777 - protein, 1652 aa, Homo sapiens
MRRLAFRGAGCALKKLDSMGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856778 - protein, 1634 aa, Homo sapiens; identical to SEQ ID NO: 856764

SEQ ID NO: 856779 - protein, 1675 aa, Homo sapiens; identical to SEQ ID NO: 856762

SEQ ID NO: 856780 - protein, 347 aa, Homo sapiens
IEDPRIIILLNEPPSLPQLQTPLASELDLMPYTPPQSTPKSAKGSAKKEGSKRKINMSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGVMNQGVAPMVGTPAPGGSPYGQQVSPQFDFLGLDRIRVILLRTCAESLFASPCGPVLFQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 856781 - protein, 124 aa, Homo sapiens
MSYIPGQPVTAVVQRVEIHKLRQGENLILGFSIGGGIDQDPSQNPFSEDKTDKGIYVTRVSEGGPAEIAGLQIGDKIMQVNGWDMTMVTHDQARKRLTKRSEEVVRLLVTRQSLQKAVQQSMLS

SEQ ID NO: 856782 - protein, 124 aa, Homo sapiens; identical to SEQ ID NO: 856781

SEQ ID NO: 856783 - protein, 124 aa, Homo sapiens; identical to SEQ ID NO: 856781

SEQ ID NO: 856784 - protein, 124 aa, Homo sapiens; identical to SEQ ID NO: 856781

SEQ ID NO: 856785 - protein, 135 aa, Homo sapiens
MRGRAERGGLCEAARARPRVLCCRLLGAALGDQSRVEMSYIPGQPVTAVVQRVEIHKLRQGENLILGFSIGGGIDQDPSQNPFSEDKTDKVNGWDMTMVTHDQARKRLTKRSEEVVRLLVTRQSLQKAVQQSMLS

SEQ ID NO: 856786 - protein, 124 aa, Homo sapiens; identical to SEQ ID NO: 856781

SEQ ID NO: 856787 - protein, 124 aa, Homo sapiens; identical to SEQ ID NO: 856781

SEQ ID NO: 856788 - protein, 124 aa, Homo sapiens; identical to SEQ ID NO: 856781

SEQ ID NO: 856789 - protein, 160 aa, Homo sapiens
MSYIPGQPVTAVVQRVEIHKLRQGENLILGFSIGGGIDQDPSQNPFSEDKTDKVRGSGVLGPLHGAQGPEMVGLCFLGLHGRNRLHLSNHALYEGIGSDLVRIRTGGVRKGCSDRAQEEQEAAISRAGAWWCSNSAPALSEQSSLTICAGRGWVQGQRDG

SEQ ID NO: 856790 - protein, 139 aa, Homo sapiens
MALRLLLGTPTSLILQPPTSLNWLFSCQQRVEIHKLRQGENLILGFSIGGGIDQDPSQNPFSEDKTDKGIYVTRVSEGGPAEIAGLQIGDKIMQVNGWDMTMVTHDQARKRLTKRSEEVVRLLVTRQSLQKAVQQSMLS

SEQ ID NO: 856791 - protein, 350 aa, Homo sapiens
MSYIPGQPVTAVVQRVEIHKLRQGENLILGFSIGGGIDQDPSQNPFSEDKTDKGIYVTRVSEGGPAEIAGLQIGDKIMQRETGWGTMEPMGSTPRNQAPANAAYTQRASKSSVWRCSCRVVARARSRVDEKRRAATTASAGCSLEQHNPPLLTNFRDRADHLTATRYTAHFIQHSSTLCPHLASADRWAPAQKGYSWSQRPGLAFLPFSHPWPGASGTSFLSWTPRIGNKGLELSSSQSAVTTGSGPTLLLGHSSGWASGNHYLLGAPKSWEMLEEPGLSRFCLAAGFGSAPAPQPSCVHTAVPLPLGGLDTHPARGATKLCPDEARWAPRSLPLSRGVLASPGFAFLRI

SEQ ID NO: 856792 - protein, 124 aa, Homo sapiens; identical to SEQ ID NO: 856781

SEQ ID NO: 856793 - protein, 805 aa, Homo sapiens
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 856794 - protein, 805 aa, Homo sapiens; identical to SEQ ID NO: 856793

SEQ ID NO: 856795 - protein, 640 aa, Homo sapiens
RGAGPLFVSSELGPSSLPPPAPPAGARPSAPEKGRPAAPATVAGRPQRPSVDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 856796 - protein, 129 aa, Homo sapiens
GSWAAFCQLRARPLLPPSARPTSRSPAQCSRERPACSTRHRRRPPATSVRPVTGCSFRCVSAELPQAATAAARTPGPFHPQRPWPCAFPRACSHPRAVGAGGIPDTWAYQGIRDPRKCYFCLSQIICGC

SEQ ID NO: 856797 - protein, 805 aa, Homo sapiens; identical to SEQ ID NO: 856793

SEQ ID NO: 856798 - protein, 780 aa, Homo sapiens
MDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 856799 - protein, 805 aa, Homo sapiens; identical to SEQ ID NO: 856793

SEQ ID NO: 856800 - protein, 780 aa, Homo sapiens; identical to SEQ ID NO: 856798

SEQ ID NO: 856801 - protein, 121 aa, Homo sapiens
AAAAIARRWPAEPPRRRRARRPREVRRPGPGRRPDGREGQPNCGRGRFLALRGLPLVSLQRRPVPRAPGPTGLESRPGDGCSGSRRPSLDWPRNVLSCWIARLQARLGLVDVVGCPACLLF

SEQ ID NO: 856802 - protein, 471 aa, Homo sapiens
RPLPLPGDGRQSRRDAEEPAARARCRRGTAFRAGPASLAGEDALVSVMGCGTSKVLPEPPKDVQLDLVKKVEPFSGTKSDVYKHFITEVDSVGPVKAGFPAASQYAHPCPGPPTAGHTEPPSEPPRRARVAKYRAKFDPRVTAKYDIKALIGRGSFSRVVRVEHRATRQPYAIKMIETKYREGREVCESELRVLRRVRHANIIQLVEVFETQERVYMVMELATGGELFDRIIAKGSFTERDATRVLQMVLDGVRYLHALGITHRDLKPENLLYYHPGTDSKIIITDFGLASARKKGDDCLMKTTCGTPEYIAPEVLVRKPYTNSVDMWALGVIAYILLSGTMPFEDDNRTRLYRQILRGKYSYSGEPWPSVSNLAKDFIDRLLTVDPGARMTALQALRHPWVVSMAASSSMKNLHRSISQNLLKRASSRCQSTKSAQSTRSSRSTRSNKSRRVRERELRELNLRYQQQYNG

SEQ ID NO: 856803 - protein, 471 aa, Homo sapiens; identical to SEQ ID NO: 856802

SEQ ID NO: 856804 - protein, 490 aa, Homo sapiens
MPTYIQLVEVFETQERVYMVMELATGGERFDRIIAKGSFTERECRRGTAFRAGPASLAGEDALVSVMGCGTSKVLPEPPKDVQLDLVKKVEPFSGTKSDVYKHFITEVDSVGPVKAGFPAASQYAHPCPGPPTAGHTEPPSEPPRRARVAKYRAKFDPRVTAKYDIKALIGRGSFSRVVRVEHRATRQPYAIKMIETKYREGREVCESELRVLRRVRHANIIQLVEVFETQERVYMVMELATGGELFDRIIAKGSFTERDATRVLQMVLDGVRYLHALGITHRDLKPENLLYYHPGTDSKIIITDFGLASARKKGDDCLMKTTCGTPEYIAPEVLVRKPYTNSVDMWALGVIAYILLSGTMPFEDDNRTRLYRQILRGKYSYSGEPWPSVSNLAKDFIDRLLTVDPGARMTALQALRHPWVVSMAASSSMKNLHRSISQNLLKRASSRCQSTKSAQSTRSSRSTRSNKSRRVRERELRELNLRYQQQYNG

SEQ ID NO: 856805 - protein, 156 aa, Homo sapiens
VYENKGTSSRWQLDLPGAWFVPHDCHQKGPKQQINNYISIGESETVYRGAPGEQSDPCGAWKCSVTPQRGEQGILPLQYCLPCHACPGAKGTSYGEMVSRRSLAVPHHHHKHWQQFLQEGPPVFKGHKSCVDSCHTCTQLHCPREGTSGIAPTPVA

SEQ ID NO: 856806 - protein, 176 aa, Homo sapiens
YQRRVPITAGEQGPRAVSEGWAAMASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSSCILPWLSKTNSCPLCRYELPTDDDTYEEHRRDKARKQQQQHRLENLHGAMYT

SEQ ID NO: 856807 - protein, 87 aa, Homo sapiens
ELGNRAPPRCRKNRRKKAQPQVHHRKGHLVGAMARGGRMPLHSSLGNKSKTPSQKKKKKKLDKLACTLLPLQCLVNFVIPQVFFLLH

SEQ ID NO: 856808 - protein, 75 aa, Homo sapiens
RRIRGRSLELARSLFNRMDFEDLGLVVDWDHHLPPPAAKTVVENLPRTVIRGSQAEEETAIEMPCHHLFHSSFSS

SEQ ID NO: 856809 - protein, 176 aa, Homo sapiens; identical to SEQ ID NO: 856806

SEQ ID NO: 856810 - protein, 176 aa, Homo sapiens; identical to SEQ ID NO: 856806

SEQ ID NO: 856811 - protein, 176 aa, Homo sapiens; identical to SEQ ID NO: 856806

SEQ ID NO: 856812 - protein, 180 aa, Homo sapiens
YQRRVPITAGEQGPRAVSEGWAAMASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSSCILPWLSKTNSCPLCRYELPTDDDTYEEHRRDKCTREEVGAECWPSASSLLTLNPH

SEQ ID NO: 856813 - protein, 208 aa, Homo sapiens
YQRRVPITAGEQGPRAVSEGWAAMASYFDEHDCEPSDPEQETRTNMLLELARSLFNRMDFEDLGLVVDWDHHLPPPAAKTVVENLPRTVIRGSQAVFQVRWGQVSFRSGSLGGRACSSSPDQHSFLKELKCPVCLLEFEEEETAIEMPCHHLFHSSCILPWLSKTNSCPLCRYELPTDDDTYEEHRRDKARKQQQQHRLENLHGAMYT

SEQ ID NO: 856814 - protein, 164 aa, Homo sapiens
YQRRVPITAGEQGPRAVSEGWAAMASYFDEHDCEPSDPEQETRTNMLLELARSLFNRMDFEDLGLVVDWDHHLPPPAAKTVVENLPRTVIRGSQAEEETAIEMPCHHLFHSSCILPWLSKTNSCPLCRYELPTDDDTYEEHRRDKARKQQQQHRLENLHGAMYT

SEQ ID NO: 856815 - protein, 104 aa, Homo sapiens
YQRRVPITAGEQGPRAVSEGWAAMASYFDEHDCEPSDPEQETRTNMLLELARSLFNRMDFEDLGLVVDWDHHLPPPAAKTVVENLPRTVIRGSQADKFLSLVPL

SEQ ID NO: 856816 - protein, 151 aa, Homo sapiens
YQRRVPITAGEQGPRAVSEGWAAMASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSSCILPWLSKARKQQQQHRLENLHGAMYT

SEQ ID NO: 856817 - protein, 104 aa, Homo sapiens; identical to SEQ ID NO: 856815

SEQ ID NO: 856818 - protein, 190 aa, Homo sapiens
YQRRVPITAGEQGPRAVSEGWAAMASYFDEHDCEPSDPEQETRTNMLLELARSLFNRMDFEDLGLVVDWDHHLPPPAAKTVVENLPRTVIRGSQAALTVPWAQYSSFFLFMDCWGMEEEWQLGAGEGGYQLMKIRPRLEHYSTFLQTNSCPLCRYELPTDDDTYEEHRRDKARKQQQQHRLENLHGAMYT

SEQ ID NO: 856819 - protein, 104 aa, Homo sapiens
YQRRVPITAGEQGPRAVSEGWAAMASYFDEHDCEPSDPEQETRTNMLLELASCILPWLSKTNSCPLCRYELPTDDDTYEEHRRDKARKQQQQHRLENLHGAMYT

SEQ ID NO: 856820 - protein, 153 aa, Homo sapiens
MASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSSCILPWLSKTNSCPLCRYELPTDDDTYEEHRRDKARKQQQQHRLENLHGAMYT

SEQ ID NO: 856821 - protein, 133 aa, Homo sapiens
VAAHTSYIIIIRSYQISARHPRVSVDPMCPSPLKPLNQAVWPGSLQANKSPTSIELLGLFLCPLITTQLFSDYLAWSLILLSSPDLLWLYCLLSYNSTSSTSPVIAQLGPQSCRSSLCSTTPTCPRDCSVMYT

SEQ ID NO: 856822 - protein, 176 aa, Homo sapiens; identical to SEQ ID NO: 856806

SEQ ID NO: 856823 - protein, 176 aa, Homo sapiens; identical to SEQ ID NO: 856806

SEQ ID NO: 856824 - protein, 176 aa, Homo sapiens; identical to SEQ ID NO: 856806

SEQ ID NO: 856825 - protein, 138 aa, Homo sapiens
YQRRVPITAGEQGPRAVSEGWAAMASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSSCILPWLSKVLLLFF

SEQ ID NO: 856826 - protein, 217 aa, Homo sapiens
YQRRVPITAGEQGPRAVSEGWAAMASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSRACPNFFFSPFLGGPPPPPLFWGGGPSRARQIPVPCAAMSCPLMTTLMRSTDEIRLENSSSNTDWRTSMEPCTREEVGAECWPSASSLLTLNPH

SEQ ID NO: 856827 - protein, 92 aa, Homo sapiens
TSHSERSQCVQSPVPFFNLFSEEEEETAIEMPCHHLFHSSCILPWLSKTNSCPLCRYELPTDDDTYEEHRRDKARKQQQQHRLENLHGAMYT

SEQ ID NO: 856828 - protein, 138 aa, Homo sapiens; identical to SEQ ID NO: 856825

SEQ ID NO: 856829 - protein, 164 aa, Homo sapiens; identical to SEQ ID NO: 856814

SEQ ID NO: 856830 - protein, 104 aa, Homo sapiens; identical to SEQ ID NO: 856815

SEQ ID NO: 856831 - protein, 1788 aa, Homo sapiens [sequence omitted]

SEQ ID NO: 856832 - protein, 2214 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHICESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856833 - protein, 1885 aa, Homo sapiens
TWAVVSWRWEIGSFGVLLEGFRKRPRLLQNYFNKKNLSFLGFPRQRKVSSFQKEFSLEDKEQLANHERGIDAQLLVALPKVAELRQIFEPKKKEFLEMKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPRCTSHSETPTVDDEEKVDERAKLSVAAKRLLFREMEKSFDEQNVPKRRSRNTAVEQRLRRLQDRSLTQPITTEEVVIAATLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856834 - protein, 2128 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHICESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAGEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856835 - protein, 2214 aa, Homo sapiens; identical to SEQ ID NO: 856832

SEQ ID NO: 856836 - protein, 1365 aa, Homo sapiens
MARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAGEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856837 - protein, 2229 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHICESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEHTLQTYKELLEFLPCRCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856838 - protein, 1024 aa, Homo sapiens
SLQSQSCSLAAELTASVLMNSSDVSSLKHPSSLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856839 - protein, 679 aa, Homo sapiens
MLSCSSYPQAAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856840 - protein, 492 aa, Homo sapiens
SHHVPKAGLELLSSSDPPTSASQRFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856841 - protein, 225 aa, Homo sapiens [sequence omitted]

SEQ ID NO: 856842 - protein, 148 aa, Homo sapiens
KKRFQGKSEKDRVSLGSTDIAICVTTGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856843 - protein, 1864 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHICESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGGPSSRSGSQKVERAK

SEQ ID NO: 856844 - protein, 1837 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHICESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAGLVSACGFFQLKEAGPAALREPASPMNPVMPSAASVQWGTAVMRL

SEQ ID NO: 856845 - protein, 1505 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHICESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKPQTALIRRPP

SEQ ID NO: 856846 - protein, 71 aa, Homo sapiens
GPGHAKQFLIRRGLSDAVSLTVSACLDIEARPDMQLESDLKLDRLETFLRRLNNKGTYWKPEGFAFRISKS

SEQ ID NO: 856847 - protein, 80 aa, Homo sapiens
NRLSRRQEGGKAPASSLHTQEAGRSLIKKVTFPMLGKAFRLTSLLEVHQKDKRVPPNSYSVKHLCIFALRVHTESLSQSS

SEQ ID NO: 856848 - protein, 176 aa, Homo sapiens
PGANGFSPALGPRLFATGPCRPGESEPDICFSSGVSAADLSLCHSVFAVGSRQKGEHSVRAAGKEKCVYFFWQGRHSTVSEKGTSALMTVELDEERGAQVSPGELCTPGTERSILSWEPMALGLVPPNMILIMEDHVTQSTSVLVWLLQVSGCASHFFPPPTFCKMILEKMLYLQI

SEQ ID NO: 856849 - protein, 80 aa, Homo sapiens
NREASKKRKVRTRSLSDFTGPPQLQALKYKDPASRRELELPSSKTEGPYGEISMLDTKVSVAQLRSAFLASANACRRPEL

SEQ ID NO: 856850 - protein, 2214 aa, Homo sapiens; identical to SEQ ID NO: 856832

SEQ ID NO: 856851 - protein, 2214 aa, Homo sapiens; identical to SEQ ID NO: 856832

SEQ ID NO: 856852 - protein, 2214 aa, Homo sapiens; identical to SEQ ID NO: 856832

SEQ ID NO: 856853 - protein, 2417 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHICESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKVGDLKNKNALANISFTHRRSVLPDVSHKASQKPGVAFKGEGIGRISFPECLSNKLSLHVEMGYFRTMTYTPVFRSWVPSYSCVKKEAAPLESPLSQVALKFCHRPVEVRLSWGKAQRIVFFKSITCDLLKMENYCSERIDTPWSFSYIFLRSLKIPSNQHPPTPVVTRLSLQAHCFSSLVLTCATLSSQGLFYPGNCVPLFFEASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856854 - protein, 2199 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHICESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQRNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856855 - protein, 1097 aa, Homo sapiens
ALAVLIALEESAYSVSIVPGSGTTLGLGVSKFEQRSNLPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856856 - protein, 354 aa, Homo sapiens
MTDPGCTGRREEEDEHVHSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 856857 - protein, 184 aa, Homo sapiens [sequence omitted]

SEQ ID NO: 856858 - protein, 2075 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHICESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQGNVASTVCDLVFLFVFGNKSLALLSRLEYSGMITAHCSFNLLGSSDQPASASQSAGLSHCAPFMFYLNSSVCLKSSVMSIMSS

SEQ ID NO: 856859 - protein, 409 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPRCTSHSETPTVDDEEKVDERAKLSVAAKRLLFREMEKSFDEQNVPKRRSRNTAVEQRLRRLQDRSLTQPITTEEVVIAATLQASAHQKALAKDQTNEGKELAEQGEPDSSTLSLAEKLALFNKLSQPVSKAILM

SEQ ID NO: 856860 - protein, 1210 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHAGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHICESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTEVVFSESRKTAADMYSRNQCLMKLGLRSKRQSTFC

SEQ ID NO: 856861 - protein, 93 aa, Homo sapiens
TYGMEPLTMRTVTSIPWILENAIRLSPGTPAAARGQLFKRADSLRSLCSHHSPLLSLFIGFSFHKRLYAVDCEYSQKEQFFNFYLTIAEIWMS

SEQ ID NO: 856862 - protein, 81 aa, Homo sapiens
WAPRCVLCAVECHSVCKYMSLLEICTSHPCDLLVGRSNEEEETSDSSLEKQTRSKYCTETSGVHGDSPYGSGTMDTHSLES

SEQ ID NO: 856863 - protein, 1696 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKCGNMDDSVLQCLLSLLSCLNNLFLLLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 856864 - protein, 248 aa, Homo sapiens
EFAAASTKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQ

SEQ ID NO: 856865 - protein, 132 aa, Homo sapiens
MVGLKDRVCILGEEINETVSSSFVARSQKTSGIGRLMVHVIEATELKACKPNGKSNPYCEISMGSQSYTTRTIQDTLNPKWNFNCQFFIKDLYQDVLCLTLFDRDQFSPDGKCRSARGSKGFPSFLDPGVQI

SEQ ID NO: 856866 - protein, 208 aa, Homo sapiens
MSHICAQRNDSMFSKSREHISGASPLSLCVRHFGELLEDGSGRKELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQDLPPSTTDVLSRPRDSSHAQRLNYRDLPPRPDEYRVTSS

SEQ ID NO: 856867 - protein, 1680 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQGFPHFVIYSYKARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 856868 - protein, 1670 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQAGAGE

SEQ ID NO: 856869 - protein, 882 aa, Homo sapiens [sequence omitted]

SEQ ID NO: 856870 - protein, 1164 aa, Homo sapiens [sequence omitted]

SEQ ID NO: 856871 - protein, 1513 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERSVLTMCGLP

SEQ ID NO: 856872 - protein, 1028 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGATYAEVT

SEQ ID NO: 856873 - protein, 1669 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 856874 - protein, 1248 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKCGNMDDSVLQCLLSLLSCLNNLFLLLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVRRLLLASSRGICCLS

SEQ ID NO: 856875 - protein, 106 aa, Homo sapiens
MIFKYSKICSEQAGKWSFLFNDFLLLTYMVKQFAVSSGSEKLFSSKSNAQFKMYKTPIFLNEVLVKLPTDPSSDEPVFHISHIDRVYTLRTDNINERSVLTMCGLP

SEQ ID NO: 856876 - protein, 1639 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDGKCRSARGSKGFPSFLDPGVQI

SEQ ID NO: 856877 - protein, 1669 aa, Homo sapiens; identical to SEQ ID NO: 856873

SEQ ID NO: 856878 - protein, 1164 aa, Homo sapiens [sequence omitted]

SEQ ID NO: 856879 - protein, 1164 aa, Homo sapiens [sequence omitted]

SEQ ID NO: 856880 - protein, 1261 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPASLKIL

SEQ ID NO: 856881 - protein, 331 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFR

SEQ ID NO: 856882 - protein, 109 aa, Homo sapiens
SGGALSVLRGERLRGKLQSTLCGALLSIFKPSEGPFISDPCRSLQKNALCVLWDESLEMMVLTLSWKLERTQQMGGVEGNRKVGLRGEAFQEACGCVKCAHCAWGEPKQ

SEQ ID NO: 856883 - protein, 169 aa, Homo sapiens
MAALLLRHVGRHCLRAHFSPQLCIRNAVPLGTTAKEEMERFWNKNIGSNRPLSPHITIYSWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 856884 - protein, 150 aa, Homo sapiens
MAALLLRHVGRHCLRAHFSPQLCIRNAVPLGTTAKEEMERFWNKNIGSNRPLSPHITIYSWSLPMAMSICHRGTGIALSADVGPRKRPEDSPAIPVWSGCPGSYCVVLYGAGSHVKKGGSQHHLPTHYYIHPSFCLSFLSPAWEKFSLFV

SEQ ID NO: 856885 - protein, 135 aa, Homo sapiens
MAALLLRHVGRHCLRAHFSPQLCIRNWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 856886 - protein, 169 aa, Homo sapiens; identical to SEQ ID NO: 856883

SEQ ID NO: 856887 - protein, 150 aa, Homo sapiens; identical to SEQ ID NO: 856884

SEQ ID NO: 856888 - protein, 169 aa, Homo sapiens; identical to SEQ ID NO: 856883

SEQ ID NO: 856889 - protein, 135 aa, Homo sapiens; identical to SEQ ID NO: 856885

SEQ ID NO: 856890 - protein, 110 aa, Homo sapiens
MTPPTPTPSRRASALGWRGRLASLPSRPEPKMAALLLRHVGRHCLRAHFSPQLCIRNAVPLGTTAKEEMERFWNKNIGSNRPLSPHITIYSWSLPMAMSICHPTACGLLA

SEQ ID NO: 856891 - protein, 132 aa, Homo sapiens
MERFWNKNIGSNRPLSPHITIYSWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 856892 - protein, 116 aa, Homo sapiens
MAALLLSWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 856893 - protein, 169 aa, Homo sapiens; identical to SEQ ID NO: 856883

SEQ ID NO: 856894 - protein, 116 aa, Homo sapiens
MAALLLRHVGRHCLRAHFSPQLCIRNWSLPMAMSICHRGTGIALSADVGPRKRPEDSPAIPVWSGCPGSYCVVLYGAGSHVKKGGSQHHLPTHYYIHPSFCLSFLSPAWEKFSLFV

SEQ ID NO: 856895 - protein, 127 aa, Homo sapiens
MAALLLRHVGRHCLRAHFSPQLCIRNAVPLGTTAKEEMERFWNKNIGSNRPLSPHITIYSWSLPMAMSICHRGTGIALSADCVVLYGAGSHVKKGGSQHHLPTHYYIHPSFCLSFLSPAWEKFSLFV

SEQ ID NO: 856896 - protein, 169 aa, Homo sapiens; identical to SEQ ID NO: 856883

SEQ ID NO: 856897 - protein, 935 aa, Homo sapiens
MTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLSALSHHSPRVPNSSVNQTEPQVSSSHNPTSTEEQQLYWAKGTGFGTGSTASGWDVEQALTKQRLEEEHVTCLLQVLASYINPVSSAVNGEAQSSHETRGQNSNALPSVLLELLSQSCLIPAMSSYLRNDSVLDMARHVPLYRALLELLRAIASCAAMVPLLLPLSTENGEEEEEQSECQTSVGTLLAKMKTCVDTYTNRLRAVITTRFNVCTKQRIPWQRPSLIAFTMLDPLSVSKTYFQLGALNSNSFSHRLQDVELRSKRENVKTGVKPDASDQEPEGLTLLVPDIQKTAEIVYAATTSLRQANQEKKLGEYSKKAAMKPKPLSVLKSLEEKYVAVMKKLQFDTFEMVSEDEDGKLGFKVNYHYMSQVKNANDANSAARARRLAQEAVTLSTSLPLSSSSSVFVRCDEERLDIMKVLITGPADTPYANGCFEFDVYFPQDYPSSPPLVNLETTGGHSVRFNPNLYNDGKVCLSILNTWHGRPEEKWNPQTSSFLQVLVSVQSLILVAEPYFNEPGYERSRGTPSGTQSSREYDGNIRQATVKWAMLEQIRNPSPCFKEVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856898 - protein, 162 aa, Homo sapiens [sequence omitted]

SEQ ID NO: 856899 - protein, 4334 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKEKSSNVKNENTSGTRKSENLRGCDLLQEVSVTIRRFKKTSISKERVQRCAMLQFSEFHEKLLNTLCRKTDDGQITEHAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSDTPSITAKLISEQKDDKEKKNHEEKEKVKAENGFQDNYSVVVASGLKSQSKRAVSATPPRPPSRRGRTIPDKIGSTSGAEAANKIITVPVFHLFHKLLAGQPLPAEMTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLSALSHHSPRVPNSSVNQTEPQVSSSHNPTSTEEQQLYWAKGTGFGTGSTASGWDVEQALTKQRLEEEHVTAFCRFLPVT

SEQ ID NO: 856900 - protein, 4353 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKESHPVNRLGCSYAILAHCNFCLPGSSDSPALASWVAGTTGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKKCNDVPCYSFQNFMRSFLILFAEKQMMARSQNMAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMVNYVLNRCWLRHLKYLEIYSYFEKAKFLIPTRCIKLFSFIKYYRTYIKRRNLLICYYGVVVFIDYSNINIKLDFFFFALLYNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGKDRERFLTGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSDTPSITAKLISEQKDDKEKKNHEEKEKVKAENGFQDNYSVVVASGLKSQSKRAVSATPPRPPSRRGRTIPDKIGSTSGAEAANKIITVPVFHLFHKLLAGQPLPAEMTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLYCFEPPFPTSSKL

SEQ ID NO: 856901 - protein, 3742 aa, Homo sapiens
QITFPLSPALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKEKSSNVKNENTSGTRKSENLRGCDLLQEVSVTIRRFKKTSISKERVQRCAMLQFSEFHEKLLNTLCRKTDDGQITEHAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGKDRERFLTGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSDTPSITAKLISEQKDDKEKKNHEEKEKVKAENGFQDNYSVVVASGLKSQSKRAVSATPPRPPSRRGRTIPDKIGSTSGAEAANKIITVPVFHLFHKLLAGQPLPAEMTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLSALSHHSPRVPNSSVNQTEPQVSSSHNPTSTEEQQLYWAKGTGFGTGSTASGWDVEQALTKQRLEEEHVTCLLQVLASYINPVSSAVNGEAQSSHETRGQNSNALPSVLLELLSQSCLIPAMSSYLRNDSVLDMARHVPLYRALLELLRAIASCAAMVPLLLPLSTENGEEEEEQSECQTSVGTLLAKMKTCVDTYTNRLRSKRENVKTGVKPDASDQEPEGLTLLVPDIQKTAEIVYAATTSLRQANQEKKLGEYSKKAAMKPKPLSVLKSLEEKYVAVMKKLQFDTFEMVSEDEDGKLGFKVNYHYMSQVKNANDANSAARARRLAQEAVTLSTSLPLSSSSSVFVRCDEERLDIMKVLITGPADTPYANGCFEFDVYFPQDYPSSPPLVNLETTGGHSVRFNPNLYNDGKVCLSILNTWHGRPEEKWNPQTSSFLQVLVSVQSLILVAEPYFNEPGYERSRGTPSGTQSSREYDGNIRQATVKWAMLEQIRNPSPCFKEVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856902 - protein, 2602 aa, Homo sapiens
MEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSDTPSITAKLISEQKDDKEKKNHEEKEKVKAENGFQDNYSVVVASGLKSQSKRAVSATPPRPPSRRGRTIPDKIGSTSGAEAANKIITVPVFHLFHKLLAGQPLPAEMTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLSALSHHSPRVPNSSVNQTEPQVSSSHNPTSTEEQQLYWAKGTGFGTGSTASGWDVEQALTKQRLEEEHVTCLLQVLASYINPVSSAVNGEAQSSHETRGQNSNALPSVLLELLSQSCLIPAMSSYLRNDSVLDMARHVPLYRALLELLRAIASCAAMVPLLLPLSTENGEEEEEQSECQTSVGTLLAKMKTCVDTYTNRLRSKRENVKTGVKPDASDQEPEGLTLLVPDIQKTAEIVYAATTSLRQANQEKKLGEYSKKAAMKPKPLSVLKSLEEKYVAVMKKLQFDTFEMVSEDEDGKLGFKVNYHYMSQVKNANDANSAARARRLAQEAVTLSTSLPLSSSSSVFVRCDEERLDIMKVLITGPADTPYANGCFEFDVYFPQDYPSSPPLVNLETTGGHSVRFNPNLYNDGKVCLSILNTWHGRPEEKWNPQTSSFLQVLVSVQSLILVAEPYFNEPGYERSRGTPSGTQSSREYDGNIRQATVKWAMLEQIRNPSPCFKEVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856903 - protein, 2349 aa, Homo sapiens
VIHDGGLLNMTVLARFTADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSDTPSITAKLISEQKDDKEKKNHEEKEKVKAENGFQDNYSVVVASGLKSQSKRAVSATPPRPPSRRGRTIPDKIGSTSGAEAANKIITVPVFHLFHKLLAGQPLPAEMTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLSALSHHSPRVPNSSVNQTEPQVSSSHNPTSTEEQQLYWAKGTGFGTGSTASGWDVEQALTKQRLEEEHVTCLLQVLASYINPVSSAVNGEAQSSHETRGQNSNALPSVLLELLSQSCLIPAMSSYLRNDSVLDMARHVPLYRALLELLRAIASCAAMVPLLLPLSTENGEEEEEQSECQTSVGTLLAKMKTCVDTYTNRLRSKRENVKTGVKPDASDQEPEGLTLLVPDIQKTAEIVYAATTSLRQANQEKKLGEYSKKAAMKPKPLSVLKSLEEKYVAVMKKLQFDTFEMVSEDEDGKLGFKVNYHYMSQVKNANDANSAARARRLAQEAVTLSTSLPLSSSSSVFVRCDEERLDIMKVLITGPADTPYANGCFEFDVYFPQDYPSSPPLVNLETTGGHSVRFNPNLYNDGKVCLSILNTWHGRPEEKWNPQTSSFLQVLVSVQSLILVAEPYFNEPGYERSRGTPSGTQSSREYDGNIRQATVKWAMLEQIRNPSPCFKEVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856904 - protein, 345 aa, Homo sapiens [sequence omitted]

SEQ ID NO: 856905 - protein, 117 aa, Homo sapiens
VICNDSLNPPPLHVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856906 - protein, 112 aa, Homo sapiens
MHAGGTVGVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856907 - protein, 116 aa, Homo sapiens
RAPPQRFPNTFAGQNPNFGTLKNPIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856908 - protein, 76 aa, Homo sapiens
VELYVGIFVISVDSVLKRHTAQLREELLKLPCPEGLDPDTDDAPEVCRATTGAEETLMHDQVKPSSSKELPSDFQL

SEQ ID NO: 856909 - protein, 3519 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKESHPVNRLGCSYAILAHCNFCLPGSSDSPALASWVAGTTGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKKCNDVPCYSFQNFMRSFLILFAEKQMMARSQNMAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGKDRERFLTGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEY

SEQ ID NO: 856910 - protein, 3919 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKESHPVNRLGCSYAILAHCNFCLPGSSDSPALASWVAGTTGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKKCNDVPCYSFQNFMRSFLILFAEKQMMARSQNMAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGKDRERFLTGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSGKSDLSISFCLTLCLMYMEVYCFYNFIFCIHFATIDD

SEQ ID NO: 856911 - protein, 2665 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKESHPVNRLGCSYAILAHCNFCLPGSSDSPALASWVAGTTGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKKCNDVPCYSFQNFMRSFLILFAEKQMMARSQNMAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGKDRERFLTGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQV

SEQ ID NO: 856912 - protein, 2293 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKESHPVNRLGCSYAILAHCNFCLPGSSDSPALASWVAGTTGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKKCNDVPCYSFQNFMRSFLILFAEKQMMARSQNMAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGKDRERFLTGNQWSFINNNLHTQSLNRSSKGSSSLDRLYSRKIRKQLVHHKQQLNLLKAKQKALVEQMEKEKIQSNKGSSYKLLVEQAKLKQATSKV

SEQ ID NO: 856913 - protein, 162 aa, Homo sapiens [sequence omitted]

SEQ ID NO: 856914 - protein, 4334 aa, Homo sapiens; identical to SEQ ID NO: 856899

SEQ ID NO: 856915 - protein, 4338 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKESHPVNRLGCSYAILAHCNFCLPGSSDSPALASWVAGTTGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKKCNDVPCYSFQNFMRSFLILFAEKQMMARSQNMAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGKDRERFLTGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSDTPSITAKLISEQKDDKEKKNHEEKEKVKAENGFQDNYSVVVASGLKSQSKRAVSATPPRPPSRRGRTIPDKIGSTSGAEAANKIITVPVFHLFHKLLAGQPLPAEMTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLSALSHHSPRVPNSSVNQTEPQVSSSHNPTSTEEQQLYWAKGTGFGTGSTASGWDVEQALTKQRLEEEHVTAFCRFLPVT

SEQ ID NO: 856916 - protein, 3631 aa, Homo sapiens
MRPVVRLPSLKHQSNKGYSLASLLAKVAAGKEKSSNVKNENTSGTRKSENLRGCDLLQEVSVTIRRFKKTSISKERVQRCAMLQFSEFHEKLLNTLCRKTDDGQITEHAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGKDRERFLTGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSDTPSITAKLISEQKDDKEKKNHEEKEKVKAENGFQDNYSVVVASGLKSQSKRAVSATPPRPPSRRGRTIPDKIGSTSGAEAANKIITVPVFHLFHKLLAGQPLPAEMTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLSALSHHSPRVPNSSVNQTEPQVSSSHNPTSTEEQQLYWAKGTGFGTGSTASGWDVEQALTKQRLEEEHVTCLLQVLASYINPVSSAVNGEAQSSHETRGQNSNALPSVLLELLSQSCLIPAMSSYLRNDSVLDMARHVPLYRALLELLRAIASCAAMVPLLLPLSTENGEEEEEQSECQTSVGTLLAKMKTCVDTYTNRLRSKRENVKTGVKPDASDQEPEGLTLLVPDIQKTAEIVYAATTSLRQANQEKKLGEYSKKAAMKPKPLSVLKSLEEKYVAVMKKLQFDTFEMVSEDEDGKLGFKVNYHYMSQVKNANDANSAARARRLAQEAVTLSTSLPLSSSSSVFVRCDEERLDIMKVLITGPADTPYANGCFEFDVYFPQDYPSSPPLVNLETTGGHSVRFNPNLYNDGKVCLSILNTWHGRPEEKWNPQTSSFLQVLVSVQSLILVAEPYFNEPGYERSRGTPSGTQSSREYDGNIRQATVKWAMLEQIRNPSPCFKEVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856917 - protein, 2472 aa, Homo sapiens
EDPCTVDRRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSDTPSITAKLISEQKDDKEKKNHEEKEKVKAENGFQDNYSVVVASGLKSQSKRAVSATPPRPPSRRGRTIPDKIGSTSGAEAANKIITVPVFHLFHKLLAGQPLPAEMTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLSALSHHSPRVPNSSVNQTEPQVSSSHNPTSTEEQQLYWAKGTGFGTGSTASGWDVEQALTKQRLEEEHVTCLLQVLASYINPVSSAVNGEAQSSHETRGQNSNALPSVLLELLSQSCLIPAMSSYLRNDSVLDMARHVPLYRALLELLRAIASCAAMVPLLLPLSTENGEEEEEQSECQTSVGTLLAKMKTCVDTYTNRLRSKRENVKTGVKPDASDQEPEGLTLLVPDIQKTAEIVYAATTSLRQANQEKKLGEYSKKAAMKPKPLSVLKSLEEKYVAVMKKLQFDTFEMVSEDEDGKLGFKVNYHYMSQVKNANDANSAARARRLAQEAVTLSTSLPLSSSSSVFVRCDEERLDIMKVLITGPADTPYANGCFEFDVYFPQDYPSSPPLVNLETTGGHSVRFNPNLYNDGKVCLSILNTWHGRPEEKWNPQTSSFLQVLVSVQSLILVAEPYFNEPGYERSRGTPSGTQSSREYDGNIRQATVKWAMLEQIRNPSPCFKEVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856918 - protein, 473 aa, Homo sapiens
MARHVPLYRALLELLRAIASCAAMVPLLLPLSTENGEEEEEQSECQTSVGTLLAKMKTCVDTYTNRLRSKRENVKTGVKPDASDQEPEGLTLLVPDIQKTAEIVYAATTSLRQANQEKKLGEYSKKAAMKPKPLSVLKSLEEKYVAVMKKLQFDTFEMVSEDEDGKLGFKVNYHYMSQVKNANDANSAARARRLAQEAVTLSTSLPLSSSSSVFVRCDEERLDIMKVLITGPADTPYANGCFEFDVYFPQDYPSSPPLVNLETTGGHSVRFNPNLYNDGKVCLSILNTWHGRPEEKWNPQTSSFLQVLVSVQSLILVAEPYFNEPGYERSRGTPSGTQSSREYDGNIRQATVKWAMLEQIRNPSPCFKEVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856919 - protein, 118 aa, Homo sapiens
MLEQIRNPSPCFKEVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 856920 - protein, 4338 aa, Homo sapiens; identical to SEQ ID NO: 856915

SEQ ID NO: 856921 - protein, 4338 aa, Homo sapiens; identical to SEQ ID NO: 856915

SEQ ID NO: 856922 - protein, 4338 aa, Homo sapiens; identical to SEQ ID NO: 856915

SEQ ID NO: 856923 - protein, 3021 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKESHPVNRLGCSYAILAHCNFCLPGSSDSPALASWVAGTTGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKKCNDVPCYSFQNFMRSFLILFAEKQMMARSQNMAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGKDRERFLTGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGMY

SEQ ID NO: 856924 - protein, 2368 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKESHPVNRLGCSYAILAHCNFCLPGSSDSPALASWVAGTTGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKKCNDVPCYSFQNFMRSFLILFAEKQMMARSQNMAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDASTFTVSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGKDRERFLTGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVCKL

SEQ ID NO: 856925 - protein, 990 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKESHPVNRLGCSYAILAHCNFCLPGSSDSPALAS

SEQ ID NO: 856926 - protein, 66 aa, Homo sapiens
LVQASGEGCLPQASRSACPSALGRELADIPICLGDTITWGIRVLMPSWCCAWGLEGLVLRGVKRFT

SEQ ID NO: 856927 - protein, 288 aa, Homo sapiens
MHVAKVHPKGGEMVGAIRNAAFLAKPSIPQVPNYRLSMTIPDWLQAIQNYMKTLQYNHTGTQFFEIRKMRPLSGLMETAKEMTRESLPIKCLEAVILGIYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 856928 - protein, 304 aa, Homo sapiens
MHVAKVHPKGGEMVGAIRNAAFLAKPSIPQVPNYRLSMTIPDWLQAIQNYMKTLQYPSNQGLSTPSQGTGMVIASLVANLSPAGHQKLSKLMETAKEMTRESLPIKCLEAVILGIYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 856929 - protein, 213 aa, Homo sapiens
METAKEMTRESLPIKCLEAVILGIYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 856930 - protein, 158 aa, Homo sapiens
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQNTDVYPGLAVFFQNALIFFSTLIYKFGRTEELWT

SEQ ID NO: 856931 - protein, 139 aa, Homo sapiens
ARWRPDPGPKKILGPGLGWSAVVQPQLTAPSNAGAQAILLPPLPKQLGPQMYPPLLAGHHPAAQQKKLFCLRFPERSKGASGLGPCFGSKRLENIFLLLFRKRDNGHRVPDVILWTRKKQAPASTDSNENVPTEIRMTC

SEQ ID NO: 856932 - protein, 158 aa, Homo sapiens; identical to SEQ ID NO: 856930

SEQ ID NO: 856933 - protein, 158 aa, Homo sapiens; identical to SEQ ID NO: 856930

SEQ ID NO: 856934 - protein, 158 aa, Homo sapiens; identical to SEQ ID NO: 856930

SEQ ID NO: 856935 - protein, 126 aa, Homo sapiens
SGSVHGSNVSPFGITPLLSREDFLCTEYEAVVERCAFVKIPSCLMISFFAVFSSKCWSAVVQPQLTAPSNAGAQAILLPPLSKQLGPQMEFCSSLGEKVKLPLKKKKDHSQYLISEDVQKNIASYI

SEQ ID NO: 856936 - protein, 114 aa, Homo sapiens
ILVHKGACAQCAGSYICIHVPCLGWSAVVQPQLTAPSNAGAQAILLPPLPKQLGPQMYPPLLAGHHPAAQQKKLFCLRFPERSKDQEETGSCQHRQQRKCSHGDQDDLLKLSGG

SEQ ID NO: 856937 - protein, 135 aa, Homo sapiens
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQMLAIGGKGASY

SEQ ID NO: 856938 - protein, 158 aa, Homo sapiens; identical to SEQ ID NO: 856930

SEQ ID NO: 856939 - protein, 158 aa, Homo sapiens; identical to SEQ ID NO: 856930

SEQ ID NO: 856940 - protein, 126 aa, Homo sapiens
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQTL

SEQ ID NO: 856941 - protein, 334 aa, Homo sapiens
MKAKVASLEESEGNKQDLKALKEAVKEIQTSAKSREWDMEALRSTLQTMESDIYTEVRELVSLKQEQQAFKEAADTERLALQALTEKLLRSEESVSRLPEEIRRLEEELRQLKSDSHGPKEDGGFRHSEAFEALQQKSQGLDSRLQHVEDGVLSMQVASARQTESLESLLSKSQEHEQRLAALQGRLEGLGSSEADQDGLASTVRSLGETQLVLYGDVEELKRSVGELPSTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 856942 - protein, 334 aa, Homo sapiens; identical to SEQ ID NO: 856941

SEQ ID NO: 856943 - protein, 180 aa, Homo sapiens
MQVASARQTESLESLLSKSQEHEQRLAALQGRLEGLGSSEADQDGLASTVRSLGETQLVLYGDVEELKRSVGELPSTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 856944 - protein, 303 aa, Homo sapiens
MKAKVASLEESEGNKQDLKALKEAVKEIQTSAKSREWDMEALRSTLQTMESDIYTEVRELVSLKQEQQAFKEAADTERLALQALTEKLLRSEESVSRLPEEIRRLEEELRQLKSDSHGPKEDGGFRHSEAFEALQQSLLSKSQEHEQRLAALQGRLEGLGSSEADQDGLASTVRSLGETQLVLYGDVEELKRSVGELPSTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 856945 - protein, 334 aa, Homo sapiens; identical to SEQ ID NO: 856941

SEQ ID NO: 856946 - protein, 235 aa, Homo sapiens
TLLLECLKGFRVSEASVLLRPVGIGFRHSEAFEALQQKSQGLDSRLQHVEDGVLSMQVASARQTESLESLLSKSQEHEQRLAALQGRLEGLGSSEADQDGLASTVRSLGETQLVLYGDVEELKRSVGELPSTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 856947 - protein, 334 aa, Homo sapiens; identical to SEQ ID NO: 856941

SEQ ID NO: 856948 - protein, 334 aa, Homo sapiens; identical to SEQ ID NO: 856941

SEQ ID NO: 856949 - protein, 195 aa, Homo sapiens
KKSRNTYLNSSGESTLSSQPKMVPLSLYGTSAFCQLIRNRKVHTSMHNDLIAHMEFKQQLMLSPTVKDLVLQLITICYDELRRFEVLGIPNTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 856950 - protein, 334 aa, Homo sapiens; identical to SEQ ID NO: 856941

SEQ ID NO: 856951 - protein, 142 aa, Homo sapiens
MRRGEAPGSFFERNPLLEGCLPHGVRVVSLPDASCDIRGNYAKHPGGSECEALHPAESRVPSVPTAGPCSLSGGHQGMHRFRLPERGVLGFFQKIREESCLQWNRGSPWGMQAKSFYFNMMSMKRFAVWAALSARSVHTAFV

SEQ ID NO: 856952 - protein, 334 aa, Homo sapiens; identical to SEQ ID NO: 856941

SEQ ID NO: 856953 - protein, 334 aa, Homo sapiens; identical to SEQ ID NO: 856941

SEQ ID NO: 856954 - protein, 334 aa, Homo sapiens; identical to SEQ ID NO: 856941

SEQ ID NO: 856955 - protein, 269 aa, Homo sapiens
THRTRNSFRPFREYFSTFTNNLSRWSEESVSRLPEEIRRLEEELRQLKSDSHGPKEDGGFRHSEAFEALQQKSQGLDSRLQHVEDGVLSMQVASARQTESLESLLSKSQEHEQRLAALQGRLEGLGSSEADQDGLASTVRSLGETQLVLYGDVEELKRSVGELPSTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 856956 - protein, 202 aa, Homo sapiens
GPPGRRAWQALPARLARPPLPGGGVGAAAAEAGPLLPPPRPGLLPRPRVLSPPPRPRRPARAGSAGRSTFSSTSPWWRRPLSRAGASTTSWRRSSRSGAATTDFSRQREELGQGLQGVEQKVQSLQATFGTFESILRSSQHKQDLTEKAVKQGESEVSRISEVLQKLQNEILKDLSDGIHVVKDARERDLHVPGKNTVEGAA

SEQ ID NO: 856957 - protein, 334 aa, Homo sapiens; identical to SEQ ID NO: 856941

SEQ ID NO: 856958 - protein, 334 aa, Homo sapiens; identical to SEQ ID NO: 856941

SEQ ID NO: 856959 - protein, 334 aa, Homo sapiens; identical to SEQ ID NO: 856941

SEQ ID NO: 856960 - protein, 54 aa, Homo sapiens
AKHLGVQPGPPGSSVEEPLAGPASLMSLSISATSAPLSFYRTRSLPTHFLLGKP

SEQ ID NO: 856961 - protein, 251 aa, Homo sapiens
NLKALRFWQLWRMRENMARGPCNAPRWASLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVGGAQSPISKQRRRALSNHTPPPSTDTLLSLQTPW

SEQ ID NO: 856962 - protein, 285 aa, Homo sapiens
MENVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPELLQDIMNYIVPILVLPRVNEKLQKGFPLPTPARVQLYNVVLQPHQNFLLFGADVVYK

SEQ ID NO: 856963 - protein, 452 aa, Homo sapiens
NLKALRFWQLWRMRENMARGPCNAPRWASLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVSLRPLVASSSF

SEQ ID NO: 856964 - protein, 248 aa, Homo sapiens
MENVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMELLQDIMNYIVPILVLPRVNEKLQKGFPLPTPARVQLYNVVLQPHQNFLLFGADVVYK

SEQ ID NO: 856965 - protein, 339 aa, Homo sapiens
NLKALRFWQLWRMRENMARGPCNAPRWASLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKASRFKRPSW

SEQ ID NO: 856966 - protein, 83 aa, Homo sapiens
AQEEGLSGRDREPGRKPREAPTSSVKEEELAKKSGEKPVGDRKKAEGLGHRTLEGVFLEGNGQPHQELPSSQEMQGLKRLLDY

SEQ ID NO: 856967 - protein, 498 aa, Homo sapiens
NLKALRFWQLWRMRENMARGPCNAPRWASLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPELLQDIMNYIVPILVLPRVNEKLQKGFPLPTPARVQLYNVVLQPHQNFLLFGADVVYK

SEQ ID NO: 856968 - protein, 212 aa, Homo sapiens
MEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPELLQDIMNYIVPILVLPRVNEKLQKGFPLPTPARVQLYNVVLQPHQNFLLFGADVVYK

SEQ ID NO: 856969 - protein, 429 aa, Homo sapiens
NLKALRFWQLWRMRENMARGPCNAPRWASLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMVSSSWVGQMRSPRQSQQHCLWSQETM

SEQ ID NO: 856970 - protein, 111 aa, Homo sapiens
HAGARSGLGVDGQQVGGTDSGAAFLSGMYAHASPYLGPGMLVQGGCLPRLSGPPSSPALLFLFSWSSPSVSVTEKLQKGFPLPTPARVQLYNVVLQPHQNFLLFGADVVYK

SEQ ID NO: 856971 - protein, 98 aa, Homo sapiens
VKVWQLSTEFTEQGPREAEDLDCLELSLKYLFAVRWSPVRPLVFAAASGKGDVQLFDLQKSSQKPTVLIKQTQDESPVYCLEFNSQQTQLLVCRALCF

SEQ ID NO: 856972 - protein, 536 aa, Homo sapiens
MATRAQPGPLSQAGSAGVAALATVGVASGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856973 - protein, 532 aa, Homo sapiens
NYRLGTRLVVSAGVAALATVGVASGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856974 - protein, 539 aa, Homo sapiens
TRGSGRVGPDAWVDPRVSAGVAALATVGVASGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856975 - protein, 439 aa, Homo sapiens
MATRAQPGPLSQAGSAGVAALATVGVASGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRPEVNFPTGHLLWVSSTISEADDGFPFLGPDSGPSWGGRAVAPEGFTHLPGGPWGENTL

SEQ ID NO: 856976 - protein, 265 aa, Homo sapiens
MTPTQTLCPSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856977 - protein, 295 aa, Homo sapiens
MATRAQPGPLSQAGSAGVAALATVGVASGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQGVVAELGQHVPVLVWPSGRPSAGS

SEQ ID NO: 856978 - protein, 509 aa, Homo sapiens
AGSQDEEVAEIQARVVGRRRQQEQRERWTDLRDTEKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856979 - protein, 540 aa, Homo sapiens
VKRWCLRRWLTCRGVADAVPWCAVWLCHVACMHVTDDLCVLCAVLCPSADVKCAKSMCAFLLCGGLKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856980 - protein, 315 aa, Homo sapiens
MGTGARLSPSCVPGTWTGETCVPSNRRPWWRSPALSCVWPSTPRSPPTSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856981 - protein, 221 aa, Homo sapiens [sequence omitted]

SEQ ID NO: 856982 - protein, 419 aa, Homo sapiens
WGPFSRECHTLGVLEWSVGHFNTQSSVLVVTRTQRVCPGLVGREVGWVIGAPPRGTAGSSLSLHRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856983 - protein, 346 aa, Homo sapiens
MTSSQVALPPGPGPGPVGGLGRVFGQEAQAGGGAEPLPRSTVPAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856984 - protein, 138 aa, Homo sapiens
APCIPSRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856985 - protein, 174 aa, Homo sapiens
GWNSGEESGRGPGSGPGLGAVERPEEAGALGKPSVVGGRQRWRELPGAGQGCPAKLPGVQQGSWGLGLSLCGDDFQPSGSAAWPWPWPCRWAGAGVWPGSQAGGGAEPLPRSTVPAGGLYSGEVLVWDLSRLEDPLLWRTGLTDDTHTDPVSQGQGRGCRAGWALRQSWGEGAH

SEQ ID NO: 856986 - protein, 536 aa, Homo sapiens; identical to SEQ ID NO: 856972

SEQ ID NO: 856987 - protein, 536 aa, Homo sapiens; identical to SEQ ID NO: 856972

SEQ ID NO: 856988 - protein, 460 aa, Homo sapiens
MATRAQPGPLSQAGSAGVAALATVGVASGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPREAEDLDCLAAEVAA

SEQ ID NO: 856989 - protein, 495 aa, Homo sapiens
MATRAQPGPLSQAGSAGVAALATVGVASGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKSIPAGETEDGAATAENYSSFDPEEQNNTGRTGKGRNTRINMYPGTSLEEARPYQTDAQDQRPNAETPEQVINLFYRPKERYPIYSLHELVPHIINRRYSYYIGSGTGDNQQGEVGPNLSVTKCIGRGPHTQLEYPAEKITRKRSNRTGAAAWVPPKWAATGHTDRRRI

SEQ ID NO: 856990 - protein, 519 aa, Homo sapiens
LSARYEAGWWSGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856991 - protein, 707 aa, Homo sapiens
MATRAQPGPLSQAGSAGVAALATVGVASGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGELPAVSASSPLRTQLPALQRATGSFPWALWPGDRKAGPDPLSLEPRWRSAVSPEGWNSGEESGRGPGSGPGLGAVERPEEAGALGKPSVVGGRQRWRELPGAGQGCPAKLPGVQQGSWGLGLSLCGDDFQPSGSAAWPWPWPCRWAGAGVWPGSQAGGGAEPLPRSTVPAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856992 - protein, 584 aa, Homo sapiens
MATRAQPGPLSQAGSAGVAALATVGVASGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGELLLCPPPLLSGLSFPPCRGPQGAFHGPFGPETGRRALTLSVWSPGEGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856993 - protein, 527 aa, Homo sapiens
MATRAQPGPLSQAGSAGVAALATVGVASGPGPGRPGPLQDETLGVASVPSQWRAVQGIRGETKSCQTASIATASASAQARNHVDAQVQTEAPVPVSVQPPSQYDIPRLAAFLRRVEAMVIRELNKNWQSHAFDGFEVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856994 - protein, 287 aa, Homo sapiens
MGTGARLSPSCVPGTWTGETCVPSNRRPWWRSPALSCVWPSTPRSPPTSQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856995 - protein, 271 aa, Homo sapiens
MATRAQPGPLSQAGSAGVAALATVGVASGPGPGRPGPLQDETLGVASVPSQWRAVQGIRGETHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856996 - protein, 191 aa, Homo sapiens
ASGHTAPAGVEGREHGIAVLECKVPNSRIPTAWFREDQRQLSPWQLAPELTQGRAAPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 856997 - protein, 325 aa, Homo sapiens
MPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRDIKDTTVGTLSQRITNQVHGLKGLNSKLLDIRSYLEKVATGKLPINHQIIYQLQDVFNLLPDVSLQEFVKAFYLKTNDQMVVVYLASLIRSVVALHNLINNKIANRDAEKTTEGQEKEESKKDRKEDKEKDKDKEKSDVKKEEKKEKK

SEQ ID NO: 856998 - protein, 325 aa, Homo sapiens; identical to SEQ ID NO: 856997

SEQ ID NO: 856999 - protein, 306 aa, Homo sapiens
MPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRDIKDTTVGTLSQRITNQVHGLKGLNSKLLDIRSYLDVFNLLPDVSLQEFVKAFYLKTNDQMVVVYLASLIRSVVALHNLINNKIANRDAEKTTEGQEKEESKKDRKEDKEKDKDKEKSDVKKEEKKEKK

SEQ ID NO: 857000 - protein, 315 aa, Homo sapiens
GGVLEDPSDGDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRDIKDTTVGTLSQRITNQVHGLKGLNSKLLDIRSYLEKVATGKLPINHQIIYQLQDVFNLLPDVSLQEFVKAFYLKTNDQMVVVYLASLIRSVVALHNLINNKIANRDAEKTTEGQEKEESKKDRKEDKEKDKDKEKSDVKKEEKKEKK

SEQ ID NO: 857001 - protein, 229 aa, Homo sapiens
MPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRDIKDTTVGTLSQRITNQVHGLKGLNSKLLDIRSYLEKVATGKLPINHQGGDW

SEQ ID NO: 857002 - protein, 325 aa, Homo sapiens; identical to SEQ ID NO: 856997

SEQ ID NO: 857003 - protein, 325 aa, Homo sapiens; identical to SEQ ID NO: 856997

SEQ ID NO: 857004 - protein, 177 aa, Homo sapiens
MPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLR

SEQ ID NO: 857005 - protein, 499 aa, Homo sapiens
PSSSTFLLAEMAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTHKGEIPALPPCKFTGSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGSTPICEDIGRQMLCYNRRIPIPELEARIDAVNAETIREVCTKYIYNRSPAIAAVGPIKQLPDFKQIRSNMCWLRD

SEQ ID NO: 857006 - protein, 230 aa, Homo sapiens
PSSSTFLLAEMAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENINL

SEQ ID NO: 857007 - protein, 499 aa, Homo sapiens; identical to SEQ ID NO: 857005

SEQ ID NO: 857008 - protein, 499 aa, Homo sapiens; identical to SEQ ID NO: 857005

SEQ ID NO: 857009 - protein, 499 aa, Homo sapiens; identical to SEQ ID NO: 857005

SEQ ID NO: 857010 - protein, 455 aa, Homo sapiens
PSSSTFLLAEMAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTHKGEIPALPPCKFTGSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGKNKDIGSVFIWLICIPIVNFSFSLNRFNSNL

SEQ ID NO: 857011 - protein, 464 aa, Homo sapiens
PSSSTFLLAEMAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTHKGEIPALPPCKFTGSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGSTPICEDIGRQMLCYNRRIPIPELEARIDVSSPELLLGHV

SEQ ID NO: 857012 - protein, 455 aa, Homo sapiens; identical to SEQ ID NO: 857010

SEQ ID NO: 857013 - protein, 308 aa, Homo sapiens
PSSSTFLLAEMAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTPLLTESRLDKYQGPPPSNMETSPPKKELRLVC

SEQ ID NO: 857014 - protein, 117 aa, Homo sapiens
TLLGSPVGQKEWMRLCTSVTESEVARARNLLKTNMLLQLDGSTPICEDIGRQMLCYNRRIPIPELEARIDAVNAETIREVCTKYIYNRSPAIAAVGKPGFFSSMQKVGQVLLINSSF

SEQ ID NO: 857015 - protein, 500 aa, Homo sapiens
PSSSTFLLAEMAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTHKGEIPALPPCKFTGSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGSTPICEDIGRQMLCYNRRIPIPELEARIDAVNAETIREVCTKYIYNRSPAIAAVGKPGFFSSMQKVGQVLLINSSF

SEQ ID NO: 857016 - protein, 236 aa, Homo sapiens
PSSSTFLLAEMAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYRGLRDIYPPLRGKIVLLLLRCFHE

SEQ ID NO: 857017 - protein, 499 aa, Homo sapiens; identical to SEQ ID NO: 857005

SEQ ID NO: 857018 - protein, 500 aa, Homo sapiens; identical to SEQ ID NO: 857015

SEQ ID NO: 857019 - protein, 455 aa, Homo sapiens; identical to SEQ ID NO: 857010

SEQ ID NO: 857020 - protein, 260 aa, Homo sapiens
PSSSTFLLAEMAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGDSCEG

SEQ ID NO: 857021 - protein, 241 aa, Homo sapiens
ARLRAECPVMLTCKFIRDSAPQGEYRLPPAIHRSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGSTPICEDIGRQMLCYNRRIPIPELEARIDAVNAETIREVCTKYIYNRSPAIAAVGPIKQLPDFKQIRSNMCWLRD

SEQ ID NO: 857022 - protein, 378 aa, Homo sapiens
PSSSTFLLAEMAAAAARVVLSSAARRRLWGFSESLLIRGAAGRSLYFGENRLRSTQAATQVVLNVPETRVTCLESGLRVASEDSGLSTCTVGLLALMLEVDTTHEKAICSRPAAARRGVVIRGAGASESGGIQRRVYLTPESAAADRTTLLSVRDEHTDLTEAYHQACSTPNVVPATGSLQHHEVHKCRTTQRHLSSYALSRRETPRAFIESIASNAWNLLGIQHSLAKLLIPEHPCTHAYPSDTRPTSLCDAHNWNYQHSRQTPTGYRENPHAVRNSADTIGRHMRKINAGLALPTDPTAHYNPSQQKGDQNDGTTTTLPTQHYLHSYTVQLAPTCTSHHKTKIPQPNQSTQTPTTHNQHDHNPHIKQLGHPLHTSH

SEQ ID NO: 857023 - protein, 522 aa, Homo sapiens
MSSRPLESPPPYRPDEFKPNHYAPSNDIYGGEMHVRPMLSQPAYSFYPEDEILHFYKWTSPPGVIRILSMLIIVMCIAIFACVASTLAWDRGYGTSLLGGSVGYPYGGSGFGSYGSGYGYGYGYGYGYGGYTDPRAAKGFMLAMAAFCFIAALVIFVTSVIRSEMSRTRRYYLSVIIVSAILGIMVFIATIVYIMGVNPTAQSSGSLYGSQIYALCNQFYTPAATGLYVDQYLYHYCVVDPQEAIAIVLGFMIIVAFALIIFFAVKTRRKMDRYDKSNILWDKEHIYDEQPPNVEEWVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 857024 - protein, 522 aa, Homo sapiens; identical to SEQ ID NO: 857023

SEQ ID NO: 857025 - protein, 522 aa, Homo sapiens; identical to SEQ ID NO: 857023

SEQ ID NO: 857026 - protein, 779 aa, Homo sapiens
RRPRAAGPGMEKRAAAGLEGAPGARAQLAVVCLVNIFLTGRLSSAVPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARPSQTVLGDGFLQPAPGAAPDPPAPLMDTGSTRAAGDRPPSAPGRAPEVGPSGPPLPSGLRDPECRPVDKDRKVCREPLADGPAPADAPREPCSAQDPHPQVSTASSTLGPHSPEPLGVCRNPPPPCSPMLEASDDEALLVC

SEQ ID NO: 857027 - protein, 67 aa, Homo sapiens
APAGPVTPRPMWPRAPYGPAPPPHKDASGAAACTRAAAATPAGARHFTLQIPNLFLKIMFKTYGKNK

SEQ ID NO: 857028 - protein, 779 aa, Homo sapiens; identical to SEQ ID NO: 857026

SEQ ID NO: 857029 - protein, 566 aa, Homo sapiens
SPRRARDAAARCGRARPTGLHRHRTKTPREPPPAPGPQQPRQAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARPSQTVLGDGFLQPAPGAAPDPPAPLMDTGSTRAAGDRPPSAPGRAPEVGPSGPPLPSGLRDPECRPVDKDRKVCREPLADGPAPADAPREPCSAQDPHPQVSTASSTLGPHSPEPLGVCRNPPPPCSPMLEASDDEALLVC

SEQ ID NO: 857030 - protein, 243 aa, Homo sapiens
RRPRAAGPGMEKRAAAGLEGAPGARAQLAVVCLVNIFLTGRLSSAVPALAACSGKLEQHTERRGVIYSPAWPLNYPPGTNCSWYIQGDRGDMITISPHRPCWAMASSSLLQGLPPTPQHRSWTQAAPGRPETGPPVPPAVHRRWDLQGHPCPRACETQSAGPWTRTERSAGSHWQTAQLLQMHLGSPAQPRTRTPRSPLPAAPWAPTRQSHWGSAGTPRPPAPQCWRPAMMRPCWSVDRWARW

SEQ ID NO: 857031 - protein, 96 aa, Homo sapiens
RRPRAAGPGMEKRAAAGLEGAPGARAQLAVVCLVNIFLTGRLSSAVPALAACSGKLEQHTERRGVIYSPAWPLNYPPGTNCSWYIQGDRGDMITIR

SEQ ID NO: 857032 - protein, 70 aa, Homo sapiens
RRPRAAGPGMEKRAAAGLEGAPGARAQLAVVCLVNIFLTGRLSSAVPALEVSKHFLSFLHSFSPFWVSGP

SEQ ID NO: 857033 - protein, 127 aa, Homo sapiens
PLALELHWPLQGHCGGDQAPLRTATSPPGTNCSWYIQGDRGDMITISFRNFDVEESHQCSLDWLLLGPAAPPRQEAFRLCGSAIPPAFISARDHVWIFFHSDASSSGQAQGFRLSYIRGDGGCRAGR

SEQ ID NO: 857034 - protein, 762 aa, Homo sapiens
MGPASHGPHLYTPSPPNKRLARRLLGQLFWLLPACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARPSQTVLGDGFLQPAPGAAPDPPAPLMDTGSTRAAGDRPPSAPGRAPEVGPSGPPLPSGLRDPECRPVDKDRKVCREPLADGPAPADAPREPCSAQDPHPQVSTASSTLGPHSPEPLGVCRNPPPPCSPMLEASDDEALLVC

SEQ ID NO: 857035 - protein, 592 aa, Homo sapiens
RRPRAAGPGMEKRAAAGLEGAPGARAQLAVVCLVNIFLTGRLSSAVPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRTRTPRSPLPAAPWAPTRQSHWGSAGTPRPPAPQCWRPAMMRPCWSVDRWARW

SEQ ID NO: 857036 - protein, 168 aa, Homo sapiens
AAPAGGRARHGEARGRGAGGRAGRPGAAGRRLSGEHLSHRETQQCGSCLRPLMDTGSTRAAGDRPPSAPGRAPEVGPSGPPLPSGLRDPECRPVDKDRKVCREPLADGPAPADAPREPCSAQDPHPQVSTASSTLGPHSPEPLGVCRNPPPPCSPMLEASDDEALLVC

SEQ ID NO: 857037 - protein, 416 aa, Homo sapiens
MSGHRSTRKRCGDSHPESPVGFGHMSTTGCVLNKLFQLPTPPLSRHQLKRLEEHRYQSAGRSLLEPLMQGYWEWLVRRVPSWIAPNLITIIGLSINICTTILLVFYCPTATEQAPLWAYIACACGLFIYQSLDAIDGKQARRTNSSSPLGELFDHGCDSLSTVFVVLGTCIAVQLGTNPDWMFFCCFAGTFMFYCAHWQTYVSGTLRFGIIDVTEVQIFIIIMHLLAVIGGPPFWQSMIPVLNIQMKIFPALCTVAGTIFSCTNYFRVIFTGGVGKNGSTIAGTSVLSPFLHIGSVITLAAMIYKKSAVQLFEKHPCLYILTFGFVSAKITNKLVVAHMTKSEMHLHDTAFIGPALLFLDQYFNSFIDEYIVLWIALVFSFFDLIRYCVSVCNQIASHLHIHVFRIKVSTAHSNHH

SEQ ID NO: 857038 - protein, 416 aa, Homo sapiens; identical to SEQ ID NO: 857037

SEQ ID NO: 857039 - protein, 416 aa, Homo sapiens; identical to SEQ ID NO: 857037

SEQ ID NO: 857040 - protein, 416 aa, Homo sapiens; identical to SEQ ID NO: 857037

SEQ ID NO: 857041 - protein, 194 aa, Homo sapiens
MHLLAVIGGPPFWQSMIPVLNIQMKIFPALCTVAGTIFSCTNYFRVIFTGGVGKNGSTIAGTSVLSPFLHIGSVITLAAMIYKKSAVQLFEKHPCLYILTFGFVSAKITNKLVVAHMTKSEMHLHDTAFIGPALLFLDQYFNSFIDEYIVLWIALVFSFFDLIRYCVSVCNQIASHLHIHVFRIKVSTAHSNHH

SEQ ID NO: 857042 - protein, 416 aa, Homo sapiens; identical to SEQ ID NO: 857037

SEQ ID NO: 857043 - protein, 117 aa, Homo sapiens [sequence omitted]

SEQ ID NO: 857044 - protein, 416 aa, Homo sapiens; identical to SEQ ID NO: 857037

SEQ ID NO: 857045 - protein, 286 aa, Homo sapiens [sequence omitted]

SEQ ID NO: 857046 - protein, 392 aa, Homo sapiens [sequence omitted]

SEQ ID NO: 857047 - protein, 155 aa, Homo sapiens
MRHSLNLHRYTGVGKNGSTIAGTSVLSPFLHIGSVITLAAMIYKKSAVQLFEKHPCLYILTFGFVSAKITNKLVVAHMTKSEMHLHDTAFIGPALLFLDQYFNSFIDEYIVLWIALVFSFFDLIRYCVSVCNQIASHLHIHVFRIKVSTAHSNHH

SEQ ID NO: 857048 - protein, 210 aa, Homo sapiens [sequence omitted]

SEQ ID NO: 857049 - protein, 873 aa, Homo sapiens
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMIRYMQKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAVQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPASCASYNFSFLSPQGLSFASQGPSAPFWSVFTPRVIGTAVARYNFAARDMRELSLREGDVVRIYSRIGGDQGWWKGETNGRIGWFPSTYVEEEGIQ

SEQ ID NO: 857050 - protein, 349 aa, Homo sapiens
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMIRYMQKMGMTEDDKRNCCLLEIQETEAKYYRTLEDIEKNYMSPLRLVLSPADMAAVFINLEGKRRVSLGESTLGPPCRGTPSTLRPAAQQARRMAGRKPAAPVFTVVRKVLCFGFGVFVLFVFCLACLFFKGKKVCNYFIQISRYISVNNKRFYNSKKMMYILVC

SEQ ID NO: 857051 - protein, 844 aa, Homo sapiens
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMIRYMQKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAVQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPVFTPRVIGTAVARYNFAARDMRELSLREGDVVRIYSRIGGDQGWWKGETNGRIGWFPSTYVEEEGIQ

SEQ ID NO: 857052 - protein, 131 aa, Homo sapiens
CSLWAHLPHCARAREERALWSPSAATLAPKTSLTPPLPSLPGAHPDPTRQAPLLGGAFGMMKFQPCCPVSGTVSCPLSERPFLESWEGVCLAALPDQYIFCKNPEMGREENRDFPSLDPCQVPLQEAPLLS

SEQ ID NO: 857053 - protein, 634 aa, Homo sapiens
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMIRYMQKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTYSCTSGRLRKPGPGPKDWWPCRNYNGQPDPPRKLWLTFRREKCELLRGNRFRGEGPGKTEPGYP

SEQ ID NO: 857054 - protein, 124 aa, Homo sapiens
DLDVLCPQTQRARGPGIGGQCVPPEPFCLTSFLSGYRAGFWAPGERPSLAQGPPGSLVGLLLQLCDAAQSPSTVFTPRVIGTAVARYNFAARDMRELSLREGDVVRIYSRIGGDQGWWKGETNG

SEQ ID NO: 857055 - protein, 46 aa, Homo sapiens
MHGPQSKSSLPSSLCSVLLLQIWTPPERDQVSLLDLGPLLSPMSAI

SEQ ID NO: 857056 - protein, 131 aa, Homo sapiens; identical to SEQ ID NO: 857052

SEQ ID NO: 857057 - protein, 167 aa, Homo sapiens
CSLWAHLPHCARAREERALWSPSAATLAPKTSLTPPLPSLPGAHPDPTRQAPLLGGAFGMMKFQPCCPVSGTVSCPLSERPFLESWEGVCLAALPDQYIFCKNPVFTVVRKVLCFGFGVFVLFVFCLACLFFKGKKVCNYFIQISRYISVNNKRFYNSKKMMYILVC

SEQ ID NO: 857058 - protein, 510 aa, Homo sapiens
MAHTCSPSYSGGCGKRIIWPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAVQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPVFTPRVIGTAVARYNFAARDMRELSLREGDVVRIYSRIGGDQGWWKGETNGRIGWFPSTYVEEEGIQ

SEQ ID NO: 857059 - protein, 91 aa, Homo sapiens
RAGLDGHGGPRVLPCRPDLRLRGVACLLNAQALGVLQLCDEKAGGGGGYTLGCGAGLPASTSIQAWLLTPQPWDGGFRHLSEPISSLRKQE

SEQ ID NO: 857060 - protein, 49 aa, Homo sapiens
MVAVQNYHGNPAPPGKPVLTFQTGDVLELLRGDPESPWWEVGPGAREGR

SEQ ID NO: 857061 - protein, 105 aa, Homo sapiens
LGCREEAGGVMGMGSGRGREGPSTKAWEMRGGGGRAGEAKSQPWREHPGASVSGYTQHFATCGPAGAEDGGEEASSPCVYCRQKGLVFWFWGFCFVCVLFGLFVF

SEQ ID NO: 857062 - protein, 1374 aa, Homo sapiens
MMQGNTCHRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSRERERERHRHRDNRRSPSLERSYKKEYKRSGRSYGLSVVPEPAGCTPELPGEIIKNTDSWAPPLEIVNHRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857063 - protein, 211 aa, Homo sapiens
MHVYVRYLPDGGKEVLSMHQILLYLLRCSKALVPEEEIANMLQWEELEWQKYAEECKGMIVTNPGTKPSSVRIDQLDREQFNPDVITFPIIVHFGIRPAQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQVRIILL

SEQ ID NO: 857064 - protein, 1374 aa, Homo sapiens; identical to SEQ ID NO: 857062

SEQ ID NO: 857065 - protein, 1374 aa, Homo sapiens; identical to SEQ ID NO: 857062

SEQ ID NO: 857066 - protein, 863 aa, Homo sapiens
TLEDPEASTELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857067 - protein, 1180 aa, Homo sapiens
RERERTSLEHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSSRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLDGVSSCCQAGLKLLGSSDPPASASQSTGIRGMSHCSRPEGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857068 - protein, 229 aa, Homo sapiens
MEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857069 - protein, 1169 aa, Homo sapiens
RERERTSLEHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSSRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDEQSFSQQHLLFPDCIMITILIWCEMVSTLWL

SEQ ID NO: 857070 - protein, 1025 aa, Homo sapiens
RERERTSLEHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSSRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLDGVSSCCQAGLKLLGSSDPPASASQSTGIRGMSHCSRPEGHNQRMEFLGDSIMQLVATEYLFIHFPDHHEGHLTDSADSGPIPCPNLHCGCLFQGRKNRLWERTKYSASGNGSSNGCA

SEQ ID NO: 857071 - protein, 153 aa, Homo sapiens
AQITEQVRYSTACMPVLYSMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857072 - protein, 1141 aa, Homo sapiens
RERERTSLEHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSSRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857073 - protein, 1026 aa, Homo sapiens
GDLRTSGVVVPLQCREASLPDGAMDSSATHPSSINYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857074 - protein, 1141 aa, Homo sapiens; identical to SEQ ID NO: 857072

SEQ ID NO: 857075 - protein, 1133 aa, Homo sapiens
RERERTSLEHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSSRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857076 - protein, 514 aa, Homo sapiens
MMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857077 - protein, 1141 aa, Homo sapiens; identical to SEQ ID NO: 857072

SEQ ID NO: 857078 - protein, 299 aa, Homo sapiens
RLVEAGVNWPRQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857079 - protein, 211 aa, Homo sapiens [sequence omitted]

SEQ ID NO: 857080 - protein, 134 aa, Homo sapiens
MNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 857081 - protein, 334 aa, Homo sapiens
MMQGNTCHRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSRERERERHRHRDNRRSPSLERSYKKEYKRSGSRSPVGRRRELMGKTAGIL

SEQ ID NO: 857082 - protein, 910 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857083 - protein, 111 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGLAGVT

SEQ ID NO: 857084 - protein, 155 aa, Homo sapiens
RLRGEENVWRRRRSRLFRSVSRCCSCERPASPSRPPSAAGSQPAPRLDSLSPTPTPTLTPPVRPAAPLVAFASPHMASSAQSGGSSGGPAVPTVQRGIIKMVLSGCAIIVRGQPRGGPPPERQINLSNIRAGNLARRAAATQPDAKDTPDEVGVS

SEQ ID NO: 857085 - protein, 910 aa, Homo sapiens; identical to SEQ ID NO: 857082

SEQ ID NO: 857086 - protein, 876 aa, Homo sapiens
DRLLHQIVLCLAVLCVDTWVTLASLPQGFCPRALSCPQRSDVPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857087 - protein, 910 aa, Homo sapiens; identical to SEQ ID NO: 857082

SEQ ID NO: 857088 - protein, 638 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSS

SEQ ID NO: 857089 - protein, 645 aa, Homo sapiens
MGKTLQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857090 - protein, 563 aa, Homo sapiens
MQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857091 - protein, 589 aa, Homo sapiens
YRGSPVRRFSFPQLLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857092 - protein, 914 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADCPRPSSLSNC

SEQ ID NO: 857093 - protein, 874 aa, Homo sapiens
MAALQTTHETKQNIKPLEGSQYSLQKFGPPGTWEQRAVPLPFFSLNSGQAQPSHWHREETRTGDVHSLSRSGHCVSQTVSLGGWNERPRYDKKEAPEFAPWAGAYTRGRSGPLLYLPGKGMPSPLRRQLNEGVQSLAGGWVNLTWMRKGIVWPMAPQSWLPSIRAAWLQEAPATEVVASVASLGGSQGCPAWKTISVGHGFIWEGHRHIFHCDAVHDGGEGVQVVGICRVSREQMIPWVGAELQCTAPLWTAGGAVRAAFAGHPWLGPAPAPVAEVTLLLVEGAEQGLEALDVTGWHCAGSPPGSPVGVEQGASLQGLEASFTFLSLRFSLSVPPAAGPRTPTSSYTPYTPTAGTGLDSARGSPAPCPQGAWGLGAQGELRPLVAWWFEALEVDRQVVFPIIEAGFLVEVGGCLIQLHGVGKGLFLIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857094 - protein, 449 aa, Homo sapiens
GRVGRPTRPQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857095 - protein, 420 aa, Homo sapiens
KETLGFITFQLLFSSFLHQDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857096 - protein, 402 aa, Homo sapiens
MDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857097 - protein, 790 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNVSVGDQSVGGAIKHSSPRVKSI

SEQ ID NO: 857098 - protein, 794 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWRGGRLLPSRARRLQRKPSPSSSGILQKENKFPKYGLPAEQGSPTRNFYR

SEQ ID NO: 857099 - protein, 335 aa, Homo sapiens
EDPPEAHCNTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857100 - protein, 668 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEHPFCI

SEQ ID NO: 857101 - protein, 670 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGALAQRWASARVGPAHRVGPGEATVRHKLHVSEASVRQDLGLSTLLGDRPESGQGR

SEQ ID NO: 857102 - protein, 215 aa, Homo sapiens
TVLFLAFIGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857103 - protein, 547 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGVSRVPESSCVAQRLKSVSAYLLKDFSLCIFSSSLLFRH

SEQ ID NO: 857104 - protein, 71 aa, Homo sapiens
CWDYRHEPPCLANLTRVLWGENYRPLLARLSWESMDRSWGPSGCSLACSDLSVSLLQDDARTDAVDSVVRD

SEQ ID NO: 857105 - protein, 289 aa, Homo sapiens
MPGPEPQAGPVTTGILVLVCSPSQQLENPLACGNVVREPMSQTEGHWEEMEKRLESSYTAIVFMGTTRCASTRPRVSSPSTAGPAGHVLSRLHPLGSLCTLQSGTKSWDEQGGPELAFPEAWPQRAVLLREQGGSEYVTCWPLLPLQREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857106 - protein, 72 aa, Homo sapiens
HNLHYGDTASGPFIFSFFPLRRSSQGAPSLSEVSLVVGLLLSGRSTSATFVLEILLAGQPPHNLMQRIPLMR

SEQ ID NO: 857107 - protein, 854 aa, Homo sapiens
LINTPSTRPSGKEEKAKAGPPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857108 - protein, 869 aa, Homo sapiens
MEATEGWLGLRHSAQSLPQAAVLRVSVELVRGDSRPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857109 - protein, 910 aa, Homo sapiens; identical to SEQ ID NO: 857082

SEQ ID NO: 857110 - protein, 821 aa, Homo sapiens
ALCSPIDDAGPRLPSHSSGRTPHVPRYGRSHHHRNHERRGRNPAARHRRETANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857111 - protein, 847 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857112 - protein, 883 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGGLGEGRAGHGGGAQGETVPESDHRIPECPRVSQERQAEPVALWRLSS

SEQ ID NO: 857113 - protein, 910 aa, Homo sapiens; identical to SEQ ID NO: 857082

SEQ ID NO: 857114 - protein, 563 aa, Homo sapiens; identical to SEQ ID NO: 857090

SEQ ID NO: 857115 - protein, 543 aa, Homo sapiens
RALEKERKNGNATGILLDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857116 - protein, 906 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKKKHQRLCPSGGSNPNTQAGRQLAPASIPDCPRPSSLSNC

SEQ ID NO: 857117 - protein, 406 aa, Homo sapiens
MHQKKDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857118 - protein, 830 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRPSRESRVSCQNRVSCYPWNNGTERYCASPRQGTYELAQTRGWKSATEEAPLIRAQTEVRTNREESREQKPGRTREPRRGPEPV

SEQ ID NO: 857119 - protein, 280 aa, Homo sapiens
DAWVDPRVRYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 857120 - protein, 708 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVIRQVSFGIIEFETRTTEDVFHHSFRTTLPAEEKAGTALLSGYPQIYLTDYR

SEQ ID NO: 857121 - protein, 471 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGMRPPESQQIQRDSQIILFFYLMIG

SEQ ID NO: 857122 - protein, 187 aa, Homo sapiens
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAEHSGYHPSSKWQHHRAPPEGRFRTLCGLVDCSLHPGRRKAEGGREVCQRAQAENMERLCGSHS

SEQ ID NO: 857123 - protein, 32 aa, Homo sapiens
METFELMMQTNLATAAKEGIGFGPQPRSRQSL

SEQ ID NO: 857124 - protein, 514 aa, Homo sapiens
MVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERANSESESGIFCMSSLSDDDDLGWCNSWPSTVWHCFLKGTRLCFHKGSNKEWQDVEDFARAEGCDNEEDLQMGIHKGYGSDGLKLLSHEESVSFGESVLKLTFDPGTVEDGLLTVECKLDHPFYVKNKGWSSFYPSLTVVQHGIPCCEVHIGDVCLPPGHPDAINFDDSGVFDTFKSYDFTPMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNRAISVILGDRWKKMKNEERRMYTLEAKALAEEQKRLNPDCWKRKRTNSVCFNK

SEQ ID NO: 857125 - protein, 514 aa, Homo sapiens
MVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERANSESESGIFCMSSLSDDDDLGWCNSWPSTVWHCFLKGTRLCFHKGSNKEWQDVEDFARAEGCDNEEDLQMGIHKGYGSDGLKLLSHEESVSFGESVLKLTFDPGTVEDGLLTVECKLDHPFYVKNKGWSSFYPSLTVVQHGIPCCEVHIGDVCLPPGHPDAINFDDSGVFDTFKSYDFTPMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNRAISVILGDRWKKMKNEERRMYTLEAKALAEEQKRLNPDCWKRKRTNSGSQQH

SEQ ID NO: 857126 - protein, 516 aa, Homo sapiens
GGRRSLKDLVMATGLSEHHNMVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKTAFPHHHWKEETPVRHERANSESESGIFCMSSLSDDDDLGWCNSWPSTVWHCFLKGTRLCFHKGSNKEWQDVEDFARAEGCDNEEDLQMGIHKGYGSDGLKLLSHEESVSFGESVLKLTFDPGTVEDGLLTVECKLDHPFYVKNKGWSSFYPSLTVVQHGIPCCEVHIGDVCLPPGHPDAINFDDSGVFDTFKSYDFTPMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNRAISVILGDRWKKMKNEERRMYTLEAKALAEEQKRLNPDCWKRKRTNSGSQQH

SEQ ID NO: 857127 - protein, 441 aa, Homo sapiens [sequence omitted]

SEQ ID NO: 857128 - protein, 510 aa, Homo sapiens
GGRRSLKDLVMATGLSEHHNMVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERANSESESGIFCMSSLSDDDDLGWCNSWPSTVWHCFLKGTRLCFHKGSNKEWQDVEDFARAEGCDNEEDLQMGIHKGYGSDGLKLLSHEESVSFGESVLKLTFDPGTVEDGLLTVECKLDHPFYVKNKGWSSFYPSLTVVQHGIPCCEVHIGDVCLPPGHPDAINFDDSGVFDTFKSYDFTPMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNRRSLAVSPKLESSGTISAHCNLRLPGSKP

SEQ ID NO: 857129 - protein, 525 aa, Homo sapiens
GGRRSLKDLVMATGLSEHHNMVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERANSESESGIFCMSSLSDDDDLGWCNSWPSTVWHCFLKGTRLCFHKGSNKEWQDVEDFARAEGCDNEEDLQMGIHKGYGSDGLKLLSHEESVSFGESVLKLTFDPGTVEDGLLTVECKLDHPFYVKNKGWSSFYPSLTVVQHGIPCCEVHIGDVCLPPGHPDAINFDDSGVFDTFKSYDFTPMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNRWKKMKNEERRMYTLEAKALAEEQKRLNPDCWKRKRTNSGSQQH

SEQ ID NO: 857130 - protein, 197 aa, Homo sapiens
PRKKAPFSRKFGNFHHLDNDSQPTERHKFSHWDLCPPLCYDFTPMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNRAISVILGDRWKKMKNEERRMYTLEAKALAEEQKRLNPDCWKRKRTNSVCFNK

SEQ ID NO: 857131 - protein, 142 aa, Homo sapiens
MARQRRASLSCGGPGGQDFARSGFSKNCGSPGSSQLSSNSLYAKAVKNHSSGTVSATSPNKCKRPMNAFMLFAKKYRVEYTQMYPGKDNRAISVILGDRWKKMKNEERRMYTLEAKALAEEQKRLNPDCWKRKRTNSVCFNK

SEQ ID NO: 857132 - protein, 514 aa, Homo sapiens; identical to SEQ ID NO: 857124

SEQ ID NO: 857133 - protein, 514 aa, Homo sapiens; identical to SEQ ID NO: 857124

SEQ ID NO: 857134 - protein, 199 aa, Homo sapiens
MVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERVSLFMRLNFYKVCTTVEVH

SEQ ID NO: 857135 - protein, 514 aa, Homo sapiens; identical to SEQ ID NO: 857124

SEQ ID NO: 857136 - protein, 534 aa, Homo sapiens
GGRRSLKDLVMATGLSEHHNMVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERANSESESGIFCMSSLSDDDDLGWCNSWPSTVWHCFLKGTRLCFHKGSNKEWQDVEDFARAEGCDNEEDLQMGIHKGYGSDGLKLLSHEESVSFGESVLKLTFDPGTVEDGLLTVECKLDHPFYVKNKGWSSFYPSLTVVQHGIPCCEVHIGDVCLPPGHPDAINFDDSGVFDTFKSYDFTPMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNRAISVILGDRWKKMKNEERRMYTLEAKALAEEQKRLNPDCWKRKRTNSGSQQH

SEQ ID NO: 857137 - protein, 514 aa, Homo sapiens; identical to SEQ ID NO: 857125

SEQ ID NO: 857138 - protein, 276 aa, Homo sapiens
GGRRSLKDLVMATGLSEHHNMVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERANSESESGIFCMSSLSDDDDLGWCNSWPSTVWHCFLKGTRLCFHKGSNKEWQDVEDFARAEGCDNEEDLQMGIHKL

SEQ ID NO: 857139 - protein, 302 aa, Homo sapiens
MDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGKFLTEWGLGELPFPVRCPLYLEIFLQNSPRTCDFSMYSGCPEDRAV

SEQ ID NO: 857140 - protein, 163 aa, Homo sapiens
AVVSTQSGYYGRGVGDAPAQQKWRRHYGWRRSGQGSAFWRAVSAPRSAAFAARPPLLTNAKKKKKKKKSFVGGPGAPGRRFLKTPFCGGGGAPIVVLGTHVWPKGVFPGENPGAREQWCGVGSLPNKKKARGEPPGGVLWTTPQIAQGRGGPDRRRSTHKGTL

SEQ ID NO: 857141 - protein, 562 aa, Homo sapiens
APYPRFSTCVLRCAGRGRAGTAKMAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 857142 - protein, 469 aa, Homo sapiens
APYPRFSTCVLRCAGRGRAGTAKMAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGKFLTEWGLGELPFPVRCPLYLEIFLQNSPRTCDFSMYSGCPEDRAV

SEQ ID NO: 857143 - protein, 554 aa, Homo sapiens
GANRKEAPCAGVFNTRHEALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 857144 - protein, 581 aa, Homo sapiens
SSGINSEWLLRPGGRGRAGTAKMAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQQIIGWAQWLPLVISALWEAEDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 857145 - protein, 396 aa, Homo sapiens
SLLLAFGLLCLPWLQEGSAFPTIPLSRLFDNSYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 857146 - protein, 398 aa, Homo sapiens
GGSVRGGDGGSVRSTCPKDLIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 857147 - protein, 562 aa, Homo sapiens; identical to SEQ ID NO: 857141

SEQ ID NO: 857148 - protein, 561 aa, Homo sapiens
SSGINSEWLLRPGGRGRAGTAKMAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 857149 - protein, 428 aa, Homo sapiens
APYPRFSTCVLRCAGRGRAGTAKMAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGLWRCL

SEQ ID NO: 857150 - protein, 511 aa, Homo sapiens
RTRGSTDAWVLENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 857151 - protein, 544 aa, Homo sapiens
APYPRFSTCVLRCAGRGRAGTAKMAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 857152 - protein, 153 aa, Homo sapiens
AAAGLLGALHLVMTLVVAAARAEKEGGCPPAASLRRGCHPALAEAGRAGPGGRAAAGAPAQSWAVGYRPEPGPRGARRTEWPSLSVIPSRAFPRLLSLPFQNFLTSRTFLPLGPLGRRGIFFGFIAANRYILGHFCFLGCGWLHADRAYFKMW

SEQ ID NO: 857153 - protein, 71 aa, Homo sapiens
GSTDVKPSLELPYTPPLESKQRRNLPSKIPLPTAMTSGSKSRNAQKTKGTSKLVDNRPPARPSVRARGTEL

SEQ ID NO: 857154 - protein, 1784 aa, Homo sapiens
AAAGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITSVRPTPQNDAITVHFKPITLKASESKYTKVASISFDASKAKKPSQFSGKITVKAKEKSYSKLEIPYQAEVLDGYLGFDHAATLFHIRDSPADPVERPIYLTNTFSFAILIHDVLLPEEAKTMFKVHNFSKPVLILPNESGYIFTLLFMPSTSSMHIDNNILLITNASKFHLPVRVYTGFLDYFVLPPKIEERFIDFGVLSATEASNILFAIINSNPIELAIKSWHIIGDGLSIELVAVERGNRTTIISSLPEFEKSSLSDQSSVTLASGYFAVFRVKLTAKKLEGIHDGAIQITTDYEILTIPVKAVIAVGSLTCFPKHVVLPPSFPGKIVHQSLNIMNSFSQKVKIQQIRSLSEDVRFYYKRLRGNKEDLEPGKKSKIANIYFDPGLQCGDHCYVGLPFLSKSEPKVQPGVAMQEDMWDADWDLHQSLFKGWTGIKENSGHRLSAIFEVNTDLQKNIISKITAELSWPSILSSPRHLKFPLTNTNCSSEEEITLENPADVPVYVQFIPLALYSNPSVFVDKLVSRFNLSKVAKIDLRTLEFQVFRNSAHPLQSSTGFMEGLSRHLILNLILKPGEKKSVKVKFTPVHNRTVSSLIIVRNNLTVMDAVMVQGQGTTENLRVAGKLPGPGSSLRFKITEALLKDCTDSLKLREPNFTLKRTFKVENTGQLQIHIETIEISGYSCEGYGFKVVNCQEFTLSANASRDIIIFALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQELQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASQRSWNEFNSGPSYLWESPATDPSPSWPASSGSPTHTATSVLGNTSGLWSTTPFSSSIWSSNLSSALPFTTPANTLASIGLMGTENSPAPHAPSTSSPADDLGQTYNPWRIWSPTIGRRSSDPWSNSHFPHEN

SEQ ID NO: 857155 - protein, 710 aa, Homo sapiens
TKGDLCTKGDLCTKGDAVHEVGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQELQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASQRSWNEFNSGPSYLWESPATDPSPSWPASSGSPTHTATSVLGNTSGLWSTTPFSSSIWSSNLSSALPFTTPANTLASIGLMGTENSPAPHAPSTSSPADDLGQTYNPWRIWSPTIGRRSSDPWSNSHFPHEN

SEQ ID NO: 857156 - protein, 402 aa, Homo sapiens
SSSNCNDKWNLAGRFLRAYFPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASQRSWNEFNSGPSYLWESPATDPSPSWPASSGSPTHTATSVLGNTSGLWSTTPFSSSIWSSNLSSALPFTTPANTLASIGLMGTENSPAPHAPSTSSPADDLGQTYNPWRIWSPTIGRRSSDPWSNSHFPHEN

SEQ ID NO: 857157 - protein, 1846 aa, Homo sapiens
AAAGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITSVRPTPQNDAITVHFKPITLKASESKYTKVASISFDASKAKKPSQFSGKITVKAKEKSYSKLEIPYQAEVLDGYLGFDHAATLFHIRDSPADPVERPIYLTNTFSFAILIHDVLLPEEAKTMFKVHNFSKPVLILPNESGYIFTLLFMPSTSSMHIDNNILLITNASKFHLPVRVYTGFLDYFVLPPKIEERFIDFGVLSATEASNILFAIINSNPIELAIKSWHIIGDGLSIELVAVERGNRTTIISSLPEFEKSSLSDQSSVTLASGYFAVFRVKLTAKKLEGIHDGAIQITTDYEILTIPVKAVIAVGSLTCFPKHVVLPPSFPGKIVHQSLNIMNSFSQKVKIQQIRSLSEDVRFYYKRLRGNKEDLEPGKKSKIANIYFDPGLQCGDHCYVGLPFLSKSEPKVQPGVAMQEDMWDADWDLHQSLFKGWTGIKENSGHRLSAIFEVNTDLQKNIISKITAELSWPSILSSPRHLKFPLTNTNCSSEEEITLENPADVPVYVQFIPLALYSNPSVFVDKLVSRFNLSKVAKIDLRTLEFQVFRNSAHPLQSSTGFMEGLSRHLILNLILKPGEKKSVKVKFTPVHNRTVSSLIIVRNNLTVMDAVMVQGQGTTENLRVAGKLPGPGSSLRFKITEALLKDCTDSLKLREPNFTLKRTFKVENTGQLQIHIETIEISGYSCEGYGFKVVNCQEFTLSANASRDIIILFTPDFTASRVIRELKFITTSGSEFVFILNASLPYHMLATCAEALPRPNWELALYIIISGIMSALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQELQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASQRSWNEFNSGPSYLWESPATDPSPSWPASSGSPTHTATSVLGNTSGLWSTTPFSSSIWSSNLSSALPFTTPANTLASIGLMGTENSPAPHAPSTSSPADDLGQTYNPWRIWSPTIGRRSSDPWSNSHFPHEN

SEQ ID NO: 857158 - protein, 263 aa, Homo sapiens
MSSLFASFSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASQRSWNEFNSGPSYLWESPATDPSPSWPASSGSPTHTATSVLGNTSGLWSTTPFSSSIWSSNLSSALPFTTPANTLASIGLMGTENSPAPHAPSTSSPADDLGQTYNPWRIWSPTIGRRSSDPWSNSHFPHEN

SEQ ID NO: 857159 - protein, 1356 aa, Homo sapiens
AAAGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITSVRPTPQNDAITVHFKPITLKASESKYTKVASISFDASKAKKPSQFSGKITVKAKEKSYSKLEIPYQAEVLDGYLGFDHAATLFHIRDSPADPVERPIYLTNTFSFAILIHDVLLPEEAKTMFKVHNFSKPVLILPNESGYIFTLLFMPSTSSMHIDNNILLITNASKFHLPVRVYTGFLDYFVLPPKIEERFIDFGVLSATEASNILFAIINSNPIELAIKSWHIIGDGLSIELVAVERGNRTTIISSLPEFEKSSLSDQSSVTLASGYFAVFRVKLTAKKLEGIHDGAIQITTDYEILTIPVKAVIAVGSLTCFPKHVVLPPSFPGKIVHQSLNIMNSFSQKVKIQQIRSLSEDVRFYYKRLRGNKEDLEPGKKSKIANIYFDPGLQCGDHCYVGLPFLSKSEPKVQPGVAMQEDMWDADWDLHQSLFKGWTGIKENSGHRLSAIFEVNTDLQKNIISKITAELSWPSILSSPRHLKFPLTNTNCSSEEEITLENPADVPVYVQFIPLALYSNPSVFVDKLVSRFNLSKVAKIDLRTLEFQVFRNSAHPLQSSTGFMEGLSRHLILNLILKPGEKKSVKVKFTPVHNRTVSSLIIVRNNLTVMDAVMVQGQGTTENLRVAGKLPGPGSSLRFKITEALLKDCTDSLKLREPNFTLKRTFKVENTGQLQIHIETIEISGYSCEGYGFKVVNCQEFTLSANASRDIIILFTPDFTASRVIRELKFITTSGSEFVFILNASLPYHMLATCAEALPRPNWELALYIIISGIMSALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQELQPERLSPAPLAHPSHPERASSARHSSEDSDITSLIEAMDKDFDHHDSPALEVFTEQPPSPLPKSKGNHLPLPEIRDV

SEQ ID NO: 857160 - protein, 78 aa, Homo sapiens
FSRSPGSGLSCPPLEDVEDPPPLPEVGEVKTLTVRHTTQQGPGTLLLPSNPRVQRDVAAFSLKPVKQNTSKSFRLFSL

SEQ ID NO: 857161 - protein, 1846 aa, Homo sapiens; identical to SEQ ID NO: 857157

SEQ ID NO: 857162 - protein, 1807 aa, Homo sapiens
AAAGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITSVRPTPQNDAITVHFKPITLKASESKYTKVASISFDASKAKKPSQFSGKITVKAKEKSYSKLEIPYQAEVLDGYLGFDHAATLFHIRDSPADPVERPIYLTNTFSFAILIHDVLLPEEAKTMFKVHNFSKPVLILPNESGYIFTLLFMPSTSSMHIDNNILLITNASKFHLPVRVYTGFLDYFVLPPKIEERFIDFGVLSATEASNILFAIINSNPIELAIKSWHIIGDGLSIELVAVERGNRTTIISSLPEFEKSSLSDQSSVTLASGYFAVFRVKLTAKKLEGIHDGAIQITTDYEILTIPVKAVIAVGSLTCFPKHVVLPPSFPGKIVHQSLNIMNSFSQKVKIQQIRSLSEDVRFYYKRLRGNKEDLEPGKKSKIANIYFDPGLQCGDHCYVGLPFLSKSEPKVQPGVAMQEDMWDADWDLHQSLFKGWTGIKENSGHRLSAIFEVNTDLQKNIISKITAELSWPSILSSPRHLKFPLTNTNCSSEEEITLENPADVPVYVQFIPLALYSNPSVFVDKLVSRFNLSKVAKIDLRTLEFQVFRNSAHPLQSSTGFMEGLSRHLILNLILKPGEKKSVKVKFTPVHNRTVSSLIIVRNNLTVMDAVMVQGQGTTENLRVAGKLPGPGSSLRFKITEALLKDCTDSLKLREPNFTLKRTFKVENTGQLQIHIETIEISGYSCEGYGFKVVNCQEFTLSANASRDIIILFTPDFTASRVIRELKFITTSGSEFVFILNASLPYHMLATCAEALPRPNWELALYIIISGIMSALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQELQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASQRSWNEFNSGPSYLWESPATDPSPSWPASSGSPTHTATSVLGNTSGLWSTTPFSSSIWSSNLSSALPFTTPANTLASIGLMGTENSPAPHAPSTSSPADDLGQTYNPWRIWSPTIGRRSSDPWSNSHFPHEN

SEQ ID NO: 857163 - protein, 1722 aa, Homo sapiens
AAAGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITSVRPTPQNDAITVHFKPITLKASESKYTKVASISFDASKAKKPSQFSGKITVKAKEKSYSKLEIPYQAEVLDGYLGFDHAATLFHIRDSPADPVERPIYLTNTFSFAILIHDVLLPEEAKTMFKVHNFSKPVLILPNESGYIFTLLFMPSTSSMHIDNNILLITNASKFHLPVRVYTGFLDYFVLPPKIEERFIDFGVLSATEASNILFAIINSNPIELAIKSWHIIGDGLSIELVAVERGNRTTIISSLPEFEKSSLSDQSSVTLASGYFAVFRVKLTAKKLEGIHDGAIQITTDYEILTIPVKAVIAVGSLTCFPKHVVLPPSFPGKIVHQSLNIMNSFSQKVKIQQIRSLSEDVRFYYKRLRGNKEDLEPGKKSKIANIYFDPGLQCGDHCYVGLPFLSKSEPKVQPGVAMQEDMWDADWDLHQSLFKGWTGIKENSGHRLSAIFEVNTDLQKNIISKITAELSWPSILSSPRHLKFPLTNTNCSSEEEITLENPADVPVYVQFIPLALYSNPSVFVDKLVSRFNLSKVAKIDLRTLEFQVFRNSAHPLQSSTGFMEGLSRHLILNLILKPGEKKSVKVKFTPVHNRTVSSLIIVRNNLTVMDAVMVQGQGTTENLRVAGKLPGPGSSLRFKITEALLKDCTDSLKLREPNFTLKRTFKVENTGQLQIHIETIEISGYSCEGYGFKVVNCQEFTLSANASRDIIILFTPDFTASRVIRELKFITTSGSEFVFILNASLPYHMLATCAEALPRPNWELALYIIISGIMSALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQELQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASRSLHLQSS

SEQ ID NO: 857164 - protein, 146 aa, Homo sapiens
FSVALPPYPLDPLPAGLSAGRFLFCRSRSSVTPAACGPPLHSAAPFGPATLAAPFPSPLQQTRWQASASWAQKTPLLLTLPPPPVQLTTWDRPTTRGGYGAPRLEEEARTLGLIRTFLTRIKLSKKQTNIVGPRLDHDVPVSETSF

SEQ ID NO: 857165 - protein, 1182 aa, Homo sapiens
AAAGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITSVRPTPQNDAITVHFKPITLKASESKYTKVASISFDASKAKKPSQFSGKITVKAKEKSYSKLEIPYQAEVLDGYLGFDHAATLFHIRDSPADPVERPIYLTNTFSFAILIHDVLLPEEAKTMFKVHNFSKPVLILPNESGYIFTLLFMPSTSSMHIDNNILLITNASKFHLPVRVYTGFLDYFVLPPKIEERFIDFGVLSATEASNILFAIINSNPIELAIKSWHIIGDGLSIELVAVERGNRTTIISSLPEFEKSSLSDQSSVTLASGYFAVFRVKLTAKKLEGIHDGAIQITTDYEILTIPVKAVIAVGSLTCFPKHVVLPPSFPGKIVHQSLNIMNSFSQKVKIQQIRSLSEDVRFYYKRLRGNKEDLEPGKKSKIANIYFDPGLQCGDHCYVGLPFLSKSEPKVQPGVAMQEDMWDADWDLHQSLFKGWTGIKENSGHRLSAIFEVNTDLQKNIISKITAELSWPSILSSPRHLKFPLTNTNCSSEEEITLENPADVPVYVQFIPLALYSNPSVFVDKLVSRFNLSKVAKIDLRTLEFQVFRNSAHPLQSSTGFMEGLSRHLILNLILKPGEKKSVKVKFTPVHNRTVSSLIIVRNNLTVMDAVMVQGQGTTENLRVAGKLPGPGSSLRFKITEALLKDCTDSLKLREPNFTLKRTFKVENTGQLQIHIETIEISGYSCEGYGFKVVNCQEFTLSANASRDIIILFTPDFTASRVIRELKFITTSGSEFVFILNASLPYHMLATCAEALPRPNWELALYIIISGIMSALFLLVIGTAYLEAQGIWEPFRRRLSFEASNPPFDVGRPFDLRRIVGISSEGKYVHMLAINSLVYIDLADKITIKNKFLFIFAQEKKNQN

SEQ ID NO: 857166 - protein, 221 aa, Homo sapiens
GEQRAALPPAPKECTHPNVTNTLVQAESSDAGVRLRWGRGLTARPDASAMEEYAREPCPWRIVDDCGGAFTMGVIGGGVFQAIKGFRNAPVGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 857167 - protein, 150 aa, Homo sapiens [sequence omitted]

SEQ ID NO: 857168 - protein, 271 aa, Homo sapiens
GEQRAALPPAPKECTHPNVTNTLVQAESSDAGVRLRWGRGLTARPDASAMEEYAREPCPWRIVDDCGGAFTMGVIGGGVFQAIKGFRNAPVCRLLSEAPLFIYSCSRSVSPTVNVSSERAESRPTLFMAVSLHMAWCLAHIGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 857169 - protein, 186 aa, Homo sapiens
MAFPLQCRLLSEAPLFIYSCSRSVSPTVNVSSERAESRPTLFMAVSLHMAWCLAHIGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 857170 - protein, 153 aa, Homo sapiens
GEQRAALPPAPKECTHPNVTNTLVQAESSDAGVRLRWGRGLTARPDASAMEEYAREPCPWRIVDDCGGAFTMGVIGGGVFQAIKGFRNAPVVSPGLPWVGVGLAILPTREAALKTAWSCQSRALIHSGAHSPTMCRAWLLYLGFCRDCKHGLC

SEQ ID NO: 857171 - protein, 186 aa, Homo sapiens
MYGSSSVNSDEGSAMEEYAREPCPWRIVDDCGGAFTMGVIGGGVFQAIKGFRNAPVGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 857172 - protein, 192 aa, Homo sapiens
MIAVEPSLWVSSVAESSRPSRVSAMPLLSVSPTVNVSSERAESRPTLFMAVSLHMAWCLAHIGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 857173 - protein, 334 aa, Homo sapiens
GGAEGSTSSSSKRVHPPQRYQYTRAGGKLRRRCASTLGAWPDCAARRQRHGGVRSGALVRQWAQASGILLRRQGQPWGSGGGGIGRTEPCTRLGGLLTYLPLPPLGSCHSGSVMRGHNQRSPWRIVDDCGGAFTMGVIGGGVFQAIKGFRNAPVCRLLSEAPLFIYSCSRSVSPTVNVSSERAESRPTLFMAVSLHMAWCLAHIGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 857174 - protein, 186 aa, Homo sapiens; identical to SEQ ID NO: 857169

SEQ ID NO: 857175 - protein, 108 aa, Homo sapiens
RTVGQTWWLTPVIPALWEGKGDGSLENRSSRPAWSACRNPVSTKNTNNNNKKSAGYGGTCLYSQLLWKSKHKNVLNPGGRGCSKPRSCHCTPAWVTERDSVLKTKTNK

SEQ ID NO: 857176 - protein, 355 aa, Homo sapiens
GGRSSAAHDPERRSREAWALRRQEEDGEGRSRAAAASLAHSLAHSPAPSLPPLPSPAPALAPAHSLLGLLLGRMSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 857177 - protein, 471 aa, Homo sapiens
GGRSSAAHDPERRSREAWALRRQEEDGEGRSRAAAASLAHSLAHSPAPSLPPLPSPAPALAPAHSLLGLLLGRMSGSSLPSALALSLLLVSGSLLPGPGAAQNAGFVKSPMSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 857178 - protein, 361 aa, Homo sapiens
MSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 857179 - protein, 361 aa, Homo sapiens; identical to SEQ ID NO: 857178

SEQ ID NO: 857180 - protein, 266 aa, Homo sapiens
LQFDLRSRLHTSENEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 857181 - protein, 134 aa, Homo sapiens
MLSYSLSPLCILTFLQDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 857182 - protein, 355 aa, Homo sapiens; identical to SEQ ID NO: 857176

SEQ ID NO: 857183 - protein, 329 aa, Homo sapiens
GGRSSAAHDPERRSREAWALRRQEEDGEGRSRAAAASLAHSLAHSPAPSLPPLPSPAPALAPAHSLLGLLLGRMSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFADVTPRALSDPEPRPPQPSKTVPPHYPVVCCPTSGPQMCKRARGRATLGSQQKRRKSTPDPKEKQTCDIRLGVSGLNTGSIE

SEQ ID NO: 857184 - protein, 208 aa, Homo sapiens
GGRSSAAHDPERRSREAWALRRQEEDGEGRSRAAAASLAHSLAHSPAPSLPPLPSPAPALAPAHSLLGLLLGRMSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDIFIWGPACWSGS

SEQ ID NO: 857185 - protein, 294 aa, Homo sapiens
GGRSSAAHDPERRSREAWALRRQEEDGEGRSRAAAASLAHSLAHSPAPSLPPLPSPAPALAPAHSLLGLLLGRMSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATWPHSGLSWEFWLKLSSLW

SEQ ID NO: 857186 - protein, 303 aa, Homo sapiens
RSLLSRPRPGAKVSRGLGAAAAGGGRGRTEPSRGCLPRSLPRALARPLPPSQPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 857187 - protein, 338 aa, Homo sapiens
GGRSSAAHDPERRSREAWALRRQEEDGEGRSRAAAASLAHSLAHSPAPSLPPLPSPAPALAPAHSLLGLLLGRMSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATWPIFGLFFGDFGLNIILVVIIVVYEKRKRPDEVPDDDEPAGPMKTNSTNNHKDKNLRQRNTN

SEQ ID NO: 857188 - protein, 355 aa, Homo sapiens; identical to SEQ ID NO: 857176

SEQ ID NO: 857189 - protein, 278 aa, Homo sapiens
GGRSSAAHDPERRSREAWALRRQEEDGEGRSRAAAASLAHSLAHSPAPSLPPLPSPAPALAPAHSLLGLLLGRMSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMVSRRQARVSGCWSFPCRGPDTWVSYCSSCILGCVHGEGHPF

SEQ ID NO: 857190 - protein, 161 aa, Homo sapiens
GGRSSAAHDPERRSREAWALRRQEEDGEGRSRAAAASLAHSLAHSPAPSLPPLPSPAPALAPAHSLLGLLLGRMSGSSLPSALALSLLLVSGSLLPGPGAAQNEPRIVTSEEVIIRDSPVLPVTLQCNLTSSSHTLTYSYWTKNGVELSATRKNASNMEYR

SEQ ID NO: 857191 - protein, 661 aa, Homo sapiens
MQSSGSFNYARPKQFIAAQNLGPASGHGTPASSPSSSSLPSPMSPTPRQFGRAPVPPFAQPFGAEPEAPWGSSSPSPRAPPPPVFSPTAAFPVPDVFPLPPPPPPLPSPGQASHCSSPATRFGHGQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 857192 - protein, 663 aa, Homo sapiens
KERNQKPKCICRPKGYSSAPWVVLKTSRHGGSGPRRATARRPPAPARPASRRPCPRRRGSSAAPPCRPSRSPSALSPRPRGAPPRRRPAPAAFPVPDVFPLPPPPPPLPSPGQASHCSSPATRFGHGQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 857193 - protein, 522 aa, Homo sapiens
WLVEAGGESAEAKVSPPAGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 857194 - protein, 171 aa, Homo sapiens
VVLLSWWCCCPGGAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 857195 - protein, 428 aa, Homo sapiens
MSALASRSAPAMQSSGSFNYARPKQFIAAQNLGPASGHGTPASSPSSSSLPSPMSPTPRQFGRAPVPPFAQPFGAEPEAPWGSSSPSPRAPPPPVFSPTAAFPVPDVFPLPPPPPPLPSPGQASHCSSPATRFGHGQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRYLTCSFPEVLHYFIYYYKCSTIRIII

SEQ ID NO: 857196 - protein, 277 aa, Homo sapiens
MQSSGSFNYARPKQFIAAQNLGPASGHGTPASSPSSSSLPSPMSPTPRQFGRAPVPPFAQPFGAEPEAPWGSSSPSPRAPPPPVFSPTAAFPVPDVFPLPPPPPPLPSPGQASHCSSPATRFGHGQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQVPCCSGLLRVTFILSPFSIFLMDTVLGMSSVESRGQVTEKQY

SEQ ID NO: 857197 - protein, 385 aa, Homo sapiens
MAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 857198 - protein, 118 aa, Homo sapiens
PSLANTENCSYESMGESNNDHFQHFPPPPPILETSSLELASKKPSEIQQVNNPELGLSRAALQMQFNAAERETNGVHPSRGVNGLINGKANSNKSLPTPAVLLSPTKEPPPLLAKPKL

SEQ ID NO: 857199 - protein, 752 aa, Homo sapiens
PSLANTENCSYESMGESNNDHFQHFPPPPPILETSSLELASKKPSEIQQVNNPELGLSRAALQMQFNAAERETNGVHPSRGVNGLINGKANSNKSLPTPAVLLSPTKEPPPLLAKPKLGTPASSPSSSSLPSPMSPTPRQFGRAPVPPFAQPFGAEPEAPWGSSSPSPRAPPPPVFSPTAAFPVPDVFPLPPPPPPLPSPGQASHCSSPATRFGHGQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 857200 - protein, 685 aa, Homo sapiens
MQSSGSFNYARPKQFIAAQNLGPASGHGTPASSPSSSSLPSPMSPTPRQFGRAPVPPFAQPFGAEPEAPWGSSSPSPRAPPPPVFSPTAAFPVPDVFPLPPPPPPLPSPGQASHCSSPATRFGHGQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYSECHFISFHCVYSLNYEKLDIWTANHITLYKQLLCFICQKNSYCSLSLSICSFSTLIVNHTRRTNTQVSFRNFELLAKYAC

SEQ ID NO: 857201 - protein, 306 aa, Homo sapiens
MSALASRSAPAMQSSGSFNYARPKQFIAAQNLGPASGHGTPASSPSSSSLPSPMSPTPRQFGRAPVPPFAQPFGAEPEAPWGSSSPSPRAPPPPVFSPTAAFPVPDVFPLPPPPPPLPSPGQASHCSSPATRFGHGQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQVPCCSGLLRVTFILSPFSIFLMDTVLGMSSGATTFTLIFFLATSLARARENPTNPPLLAL

SEQ ID NO: 857202 - protein, 113 aa, Homo sapiens
IPQPDSPPRRITHRGQLERPRRSRFDFGASALAGRDWLRPRDGVVSASLPAAARRVLPRAMTASAQPRGRRPGVGVGVVVTSCKHPRCVLLGKRKGSVGAGSFQLPGGHLEFG

SEQ ID NO: 857203 - protein, 224 aa, Homo sapiens
IPQPDSPPRRITHRGQLERPRRSRFDFGASALAGRDWLRPRDGVVSASLPAAARRVLPRAMTASAQPRGRRPGVGVGVVVTSCKHPRCVLLGKRKGSVGAGSFQLPGGHLEFGETWEECAQRETWEEAALHLKNVHFASVVNSFIEKENYHYVTILMKGEVDVTHDSEPKNVEPEKNESWEWVPWEELPPLDQLFWGLRCLKEQGYDPFKEDLNHLVGYKGNHL

SEQ ID NO: 857204 - protein, 224 aa, Homo sapiens; identical to SEQ ID NO: 857203

SEQ ID NO: 857205 - protein, 224 aa, Homo sapiens; identical to SEQ ID NO: 857203

SEQ ID NO: 857206 - protein, 55 aa, Homo sapiens
MDTGQQGRQAAHELLAMKTDQKQMDMGQRGWQTAHKLLLSPKNEWTWGRWTILLS

SEQ ID NO: 857207 - protein, 717 aa, Homo sapiens
MRRSPPSLRLRLSADNLVAASGGCWFVLGERRAGSLLSASYGTFAMPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 857208 - protein, 677 aa, Homo sapiens
MHRGKLDCAGGALLSSYLIVLMILLAVVICTVSAIMCVSMRVFNIITELCSHHHHQVYTIFFTPERNPVPGEDTVAHTCNPSTLGSRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 857209 - protein, 391 aa, Homo sapiens
MQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 857210 - protein, 619 aa, Homo sapiens
MRRSPPSLRLRLSADNLVAASGGCWFVLGERRAGSLLSASYGTFAMPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLSSTRGLQCGRGLTRATGNCPRNDGLTLLSLN

SEQ ID NO: 857211 - protein, 296 aa, Homo sapiens
MSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 857212 - protein, 369 aa, Homo sapiens
MVPSTLHAWPRAGRAIRALRSHRWVSLFSLGFSPRTELGDGAIPAILHRSVRSRDHLSFSHPAHHRLTAASATPFLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 857213 - protein, 218 aa, Homo sapiens
MLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 857214 - protein, 621 aa, Homo sapiens
MRRSPPSLRLRLSADNLVAASGGCWFVLGERRAGSLLSASYGTFAMPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKVSGCLVERVSRTRGLSLRSCGEPGGIAPSVQGTLCCCWKFSFHHLIRFWARTL

SEQ ID NO: 857215 - protein, 621 aa, Homo sapiens; identical to SEQ ID NO: 857214

SEQ ID NO: 857216 - protein, 218 aa, Homo sapiens
DLPASASQSAGITGVSHRTQLSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 857217 - protein, 429 aa, Homo sapiens
MRRSPPSLRLRLSADNLVAASGGCWFVLGERRAGSLLSASYGTFAMPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVWTLQTAALHFFWVLELLEILMEVMNYSSRNS

SEQ ID NO: 857218 - protein, 67 aa, Homo sapiens
MLLIGSRPQYKILLHGLWYELFGGNPNNLPTELDGGDQEVLTQPLLGEQSLLTRWSPAYSFSSDSPL

SEQ ID NO: 857219 - protein, 631 aa, Homo sapiens
MHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 857220 - protein, 551 aa, Homo sapiens
MRRSPPSLRLRLSADNLVAASGGCWFVLGERRAGSLLSASYGTFAMPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQQSSAGIFSELHRVTRPGEGCDSQAQCDQLGRSEEKNLASGRALQ

SEQ ID NO: 857221 - protein, 630 aa, Homo sapiens
MRRSPPSLRLRLSADNLVAASGGCWFVLGERRAGSLLSASYGTFAMPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRATGNCPRNDGLTLLSLN

SEQ ID NO: 857222 - protein, 717 aa, Homo sapiens; identical to SEQ ID NO: 857207

SEQ ID NO: 857223 - protein, 522 aa, Homo sapiens
MRRSPPSLRLRLSADNLVAASGGCWFVLGERRAGSLLSASYGTFAMPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPQSSAGIFSELHRVTRPGEGCDSQAQCDQLGRSEEKNLASGRALQ

SEQ ID NO: 857224 - protein, 277 aa, Homo sapiens
MRRSPPSLRLRLSADNLVAASGGCWFVLGERRAGSLLSASYGTFAMPGMVLFGRRWAITMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 857225 - protein, 217 aa, Homo sapiens
MEALVGGVIVKLTSSSVWNFSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 857226 - protein, 220 aa, Homo sapiens
MRRSPPSLRLRLSADNLVAASGGCWFVLGERRAGSLLSASYGTFAMPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSLGSASGFRS

SEQ ID NO: 857227 - protein, 77 aa, Homo sapiens
TPGLKCPPALASLSAGITSVRHHTWHLLHVRRCARCQEHSHARWTWLLILQSQIPGETHTSVHSVIPSLSLCWACLV

SEQ ID NO: 857228 - protein, 1273 aa, Homo sapiens
RPFRGGAYFAATTCRTSGLPGSCCGSRMMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEVGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 857229 - protein, 1200 aa, Homo sapiens
RPFRGGAYFAATTCRTSGLPGSCCGSRMMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 857230 - protein, 1307 aa, Homo sapiens
RPFRGGAYFAATTCRTSGLPGSCCGSRMMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKGLVLVFEWGVGEVMSFSYGTEMDMTRLTLLACSSDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEVGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 857231 - protein, 602 aa, Homo sapiens
RPFRGGAYFAATTCRTSGLPGSCCGSRMMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGADEAVKKILCGIATGYPARCPWSTTIHQGTQSKNPRGSLKKEAGAPKEDLPIKKRHLTSSKEGKNGKHRTKATKTMETSAPHYRGRGKTTDKQAEETADKITTDHRH

SEQ ID NO: 857232 - protein, 1273 aa, Homo sapiens; identical to SEQ ID NO: 857228

SEQ ID NO: 857233 - protein, 1210 aa, Homo sapiens
RPFRGGAYFAATTCRTSGLPGSCCGSRMMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTRYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEVGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMVST

SEQ ID NO: 857234 - protein, 1237 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 857235 - protein, 1205 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 857236 - protein, 1205 aa, Homo sapiens; identical to SEQ ID NO: 857235

SEQ ID NO: 857237 - protein, 745 aa, Homo sapiens
MFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 857238 - protein, 1194 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 857239 - protein, 1248 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 857240 - protein, 999 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEVFSASLQNLSVQN

SEQ ID NO: 857241 - protein, 148 aa, Homo sapiens
MAVEQMPKKDWYSILGADPSANISDLKQKYQKLILMYHPDKQSTDVPAGTVEECVQKFIEIDQAWKILGNEETKREYDLQRCEDDLRNVGPVDAQVYLEEMSWNEGDHSFYLSCRCGGKYSVSKDEAEEVSLISCDTCSLIIELLHYN

SEQ ID NO: 857242 - protein, 148 aa, Homo sapiens; identical to SEQ ID NO: 857241

SEQ ID NO: 857243 - protein, 148 aa, Homo sapiens; identical to SEQ ID NO: 857241

SEQ ID NO: 857244 - protein, 148 aa, Homo sapiens; identical to SEQ ID NO: 857241

SEQ ID NO: 857245 - protein, 148 aa, Homo sapiens; identical to SEQ ID NO: 857241

SEQ ID NO: 857246 - protein, 148 aa, Homo sapiens; identical to SEQ ID NO: 857241

SEQ ID NO: 857247 - protein, 474 aa, Homo sapiens
MFLSSCTFEVSGKPFTCKEVGKDFLVRSRFLQQQAAHTRKKSNRTKSAVAFHSVKNHYNWGECVKAFSYKHVRVQHQGDLIRERSYMCSECGKSFSTSCSLSDHLRVHTSEKPYTCGECGKSYRQSSSLITHRRIHTGVRPHQCDECGKLFNRKYDLLIHQRVHTGERPYKCSECGKSFSHSSSLITHQRIHTGMRPYECSECGKSFIHSSSLITHQRVHTGTRPYMCSECGKSFSQSCHLIKHRRLHIGEGPYECSECGKLFTYRSRFFQHQRVHTGVRSHECHECGKLFSRKFDLIVHERVHTGERPYECSECGKSFTCKSYLISHWKVHTGARPYECGECGKSFTHSSTLLQHQRVHTGERPYECNECGKFFSQSSSLIRHRRSHTGERPYECSECWKSFSNHSSLVKHRRVHTGERPYECSECGKSFSQSSNLTNHQRIHSGERPYECSDCGKFFTFNSNLLKHQNVHKG

SEQ ID NO: 857248 - protein, 148 aa, Homo sapiens
MAAAELTAPAQGIVTFEDVAVYFSWKEWGLLDEAQKCLYHDVMLENLTLTTSLGGSGAGDEEAPYQQSTSPQRVSQVRIPKALPSPQKTNPCEICGPVLRQILHLVEHQGTHHGQKLYTDGACRKQLQFTAYLHQHQKQHVGQKHFSL

SEQ ID NO: 857249 - protein, 627 aa, Homo sapiens
MAAAELTAPAQGIVTFEDVAVYFSWKEWGLLDEAQKCLYHDVMLENLTLTTSLGGSGAGDEEAPYQQSTSPQRVSQVRIPKALPSPQKTNPCEICGPVLRQILHLVEHQGTHHGQKLYTDGACRKQLQFTAYLHQHQKQHVGQKHFRSNGGRDMFLSSCTFEVSGKPFTCKEVGKDFLVRSRFLQQQAAHTRKKSNRTKSAVAFHSVKNHYNWGECVKAFSYKHVRVQHQGDLIRERSYMCSECGKSFSTSCSLSDHLRVHTSEKPYTCGECGKSYRQSSSLITHRRIHTGVRPHQCDECGKLFNRKYDLLIHQRVHTGERPYKCSECGKSFSHSSSLITHQRIHTGMRPYECSECGKSFIHSSSLITHQRVHTGTRPYMCSECGKSFSQSCHLIKHRRLHIGEGPYECSECGKLFTYRSRFFQHQRVHTGVRSHECHECGKLFSRKFDLIVHERVHTGERPYECSECGKSFTCKSYLISHWKVHTGARPYECGECGKSFTHSSTLLQHQRVHTGERPYECNECGKFFSQSSSLIRHRRSHTGERPYECSECWKSFSNHSSLVKHRRVHTGERPYECSECGKSFSQSSNLTNHQRIHSGERPYECSDCGKFFTFNSNLLKHQNVHKG

SEQ ID NO: 857250 - protein, 437 aa, Homo sapiens
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQEFFFKCGAHPTSDKETPVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 857251 - protein, 73 aa, Homo sapiens
AGGVRRNYALELRLPAGPGPRPPRVRIPRAGRGGGEAGRIYPGDRWWEARLAPLRAWACSWPAAATYPVTMIG

SEQ ID NO: 857252 - protein, 465 aa, Homo sapiens
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQGPSCWDDVLIPNRMSGECQSPHCPGTSAEFFFKCGAHPTSDKETPVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 857253 - protein, 316 aa, Homo sapiens
MIVFVRFNSSHGFPVEVDSDTSIFQLKEVVAKRQGVPADQLRVIFAGKELRNDWTVQEFFFKCGAHPTSDKETPVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 857254 - protein, 212 aa, Homo sapiens
MNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 857255 - protein, 212 aa, Homo sapiens; identical to SEQ ID NO: 857254

SEQ ID NO: 857256 - protein, 212 aa, Homo sapiens; identical to SEQ ID NO: 857254

SEQ ID NO: 857257 - protein, 212 aa, Homo sapiens; identical to SEQ ID NO: 857254

SEQ ID NO: 857258 - protein, 212 aa, Homo sapiens; identical to SEQ ID NO: 857254

SEQ ID NO: 857259 - protein, 214 aa, Homo sapiens
MAMNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 857260 - protein, 228 aa, Homo sapiens
STGINAECPLRPGAAEQPPPPRAMNIFRLTGDLSHLAAIVILLLKIWKTRSCALLFALVFTTRYLDLFTSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 857261 - protein, 150 aa, Homo sapiens
MKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 857262 - protein, 245 aa, Homo sapiens
MNIFRLTGDLSHLAAIVILLLKIWKTRSCAGSCSVTQARVQGCDHSSLSLSLLESRNPPTSTSHVAGTTGLLFALVFTTRYLDLFTSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 857263 - protein, 212 aa, Homo sapiens; identical to SEQ ID NO: 857254

SEQ ID NO: 857264 - protein, 228 aa, Homo sapiens
GVRRYSAHIAIAVPRQWEEMRPLDIVELAEPEEVEVLEPEEDFEQFLLPVINEMREDIASLTREHGRAYLRNRSKLWEMDNMLIQIKTQVEASEESALNPPPEPGPPRCADRHRRRRHEHFPADWGPVPPGGHRHPAAEDLEDALLRRYFWEKPGKTGEAETITTHYLFFLGLYRALYLVNWIWRFYFEGFFDLIAVVAGVVQTILYCDFFYLYITKVLKGKKLSLPA

SEQ ID NO: 857265 - protein, 212 aa, Homo sapiens; identical to SEQ ID NO: 857254

SEQ ID NO: 857266 - protein, 212 aa, Homo sapiens; identical to SEQ ID NO: 857254

SEQ ID NO: 857267 - protein, 186 aa, Homo sapiens
MNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEYSRERSSVCQHKCQRPSPASVLQGARTEFLPQQRHKMLDTENQKLNSFVADSHQWLCKNAEEKSQKVSV

SEQ ID NO: 857268 - protein, 212 aa, Homo sapiens; identical to SEQ ID NO: 857254

SEQ ID NO: 857269 - protein, 212 aa, Homo sapiens; identical to SEQ ID NO: 857254

SEQ ID NO: 857270 - protein, 212 aa, Homo sapiens; identical to SEQ ID NO: 857254

SEQ ID NO: 857271 - protein, 186 aa, Homo sapiens; identical to SEQ ID NO: 857267

SEQ ID NO: 857272 - protein, 236 aa, Homo sapiens
RARARGSSATSLATSRAISPSSPAMNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 857273 - protein, 212 aa, Homo sapiens; identical to SEQ ID NO: 857254

SEQ ID NO: 857274 - protein, 329 aa, Homo sapiens
GVRRYSAHIAIAVPRQWEEMRPLDIVELAEPEEVEVLEPEEDFEQFLLPVINEMREDIASLTREHGRAYLRNRSKLWEMDNMLIQIKTQVEASEESALNHLQNPGRRAAPTATAAAAMNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 857275 - protein, 212 aa, Homo sapiens; identical to SEQ ID NO: 857254

SEQ ID NO: 857276 - protein, 212 aa, Homo sapiens; identical to SEQ ID NO: 857254

SEQ ID NO: 857277 - protein, 190 aa, Homo sapiens
MNIFRLTGDLSHLAAIVILLLKIWKTRSCATSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 857278 - protein, 212 aa, Homo sapiens; identical to SEQ ID NO: 857254

SEQ ID NO: 857279 - protein, 198 aa, Homo sapiens
RRTSCGVSFIKQQMRPCFSLSTPPCPLNITVLQAQTYFQTMQAMLLLQRHGEYQPISQEYLKIKVFFFQRAHTTPYVPPEVVIKKVVPFPFFYNQIDRNVRFSPGPEKLKGMNNSSPSQAQFQRCKTGEAETITTHYLFFLGLYRALYLVNWIWRFYFEGFFDLIAVVAGVVQTILYCDFFYLYITKVLKGKKLSLPA

SEQ ID NO: 857280 - protein, 212 aa, Homo sapiens; identical to SEQ ID NO: 857254

SEQ ID NO: 857281 - protein, 212 aa, Homo sapiens; identical to SEQ ID NO: 857254

SEQ ID NO: 857282 - protein, 212 aa, Homo sapiens; identical to SEQ ID NO: 857254

SEQ ID NO: 857283 - protein, 212 aa, Homo sapiens; identical to SEQ ID NO: 857254

SEQ ID NO: 857284 - protein, 212 aa, Homo sapiens; identical to SEQ ID NO: 857254

SEQ ID NO: 857285 - protein, 173 aa, Homo sapiens
EREREREREREREREMAAQGVGPGPGSAAPPGLEAARQKLALRRKKVLSTEEMELYELAQAAGGAIDPDVFKILVDLLKLNVAPLAVFQMLKSMCAGQRLASEPQDPAAVSLPTSSVPETRGRNKGSAALGGALALAERSSREGSSQRMPRQPSATRLPKGGGPGKSPTRGST

SEQ ID NO: 857286 - protein, 195 aa, Homo sapiens
MLLLLPMALSEMQHNLLGQWKKAQSWLPAWKHEETRTGILRRRGEQAAFMGGVPGPGHPHPLTQEGPGTCVLASSLTFALSALFVSLSDLQRPPFSLPGTVAPLQGPPFPPARSLRPLRFCSTARLPHTRLSLQAPRVPSASLAACSLLLQVAFIGLSLGVGALPCFHGNCLAPGGPSSFELQGQDHAGHRCPAA

SEQ ID NO: 857287 - protein, 158 aa, Homo sapiens
MAAQGVGPGPGSAAPPGLEAARQKLALRRKKVLSTEEMELYELAQAAGGAIDPDVFKILVDLLKLNVAPLAVFQMLKSMCAGQRLASEPQDPAAVSLPTSSVPETRGRNKGSAALGGALALAERSSREGSSQRMPRQPSATRLPKGGGPGKSPTRGST

SEQ ID NO: 857288 - protein, 135 aa, Homo sapiens
MAAQGVGPGPGSAAPPGLEAARQKLALRRKKVLSTEEMELYELAQAAGGAIDPDVFKILVDLLKLNVAPLAVFQMLKSMCAGQRLASEPQDPAAVSLPTSSVPETRGQSWARCPCPSGGGGGRGGGRRGTAAAWP

SEQ ID NO: 857289 - protein, 158 aa, Homo sapiens; identical to SEQ ID NO: 857287

SEQ ID NO: 857290 - protein, 158 aa, Homo sapiens; identical to SEQ ID NO: 857287

SEQ ID NO: 857291 - protein, 158 aa, Homo sapiens; identical to SEQ ID NO: 857287

SEQ ID NO: 857292 - protein, 150 aa, Homo sapiens
MAAQGVGPGPGSAAPPGLEAARQKLALRRKKVLSTEEMELYELAQAAGGAIDPDVFKILVDLLKLNVAPLAVFQMLKSMCAGQRLASEPQDPAAVSLPTSSVPETRAAQRYQAAQGGRAWEEPYTGQHLGWGRDLLHLCPQQRLHVTSFN

SEQ ID NO: 857293 - protein, 158 aa, Homo sapiens; identical to SEQ ID NO: 857287

SEQ ID NO: 857294 - protein, 144 aa, Homo sapiens
LKRRVRKAKAGRAGKRNGEAGVRGREWSLAECACVVAASGAPRILVDLLKLNVAPLAVFQMLKSMCAGQRLASEPQDPAAVSLPTSSVPETRGRNKGSAALGGALALAERSSREGSSQRMPRQPSATRLPKGGGPGKSPTRGST

SEQ ID NO: 857295 - protein, 117 aa, Homo sapiens
RAGRRGLTGPASVPARILVDLLKLNVAPLAVFQMLKSMCAGQRLASEPQDPAAVSLPTSSVPETRGRNKGSAALGGALALAERSSREGSSQRMPRQPSATRLPKGGGPGKSPTRGST

SEQ ID NO: 857296 - protein, 120 aa, Homo sapiens
AQGGRAWAGVGAIDPDVFKILVDLLKLNVAPLAVFQMLKSMCAGQRLASEPQDPAAVSLPTSSVPETRGRNKGSAALGGALALAERSSREGSSQRMPRQPSATRLPKGGGPGKSPTRGST

SEQ ID NO: 857297 - protein, 158 aa, Homo sapiens; identical to SEQ ID NO: 857287

SEQ ID NO: 857298 - protein, 158 aa, Homo sapiens; identical to SEQ ID NO: 857287

SEQ ID NO: 857299 - protein, 218 aa, Homo sapiens
MAAQGVGPGPGSAAPPGLEAARQKLALRRKKVLSTEEMELYELAQAAGGAIDPDVFKILVDLLKLNVAPLAVFQMLKSMCAGQRLASEPQDPAAVSLPTSSVPETREASFLSARNSSPPARPSFSSSPQPAASPVLLHSPAATHSPLSPGPPGSLRLSCCLFSPFAGRNKGSAALGGALALAERSSREGSSQRMPRQPSATRLPKGGGPGKSPTRGST

SEQ ID NO: 857300 - protein, 114 aa, Homo sapiens
RERERERERERERERDGGAGRRAWAGVGGAPGAGGGPAEAGAAAEEGAEHRGDGAVRAGAGGGRRYRPRRVQDPGGPAEAERGPPRRLPDAQQPSATRLPKGGGPGKSPTRGST

SEQ ID NO: 857301 - protein, 860 aa, Homo sapiens
MEIGSAGPAGAQPLLMVPRRPGYGTMGKPIKLLANCFQVEIPKIDVYLYEVDIKPDKCPRRVNREVVDSMVQHFKVTIFGDRRPVYDGKRSLYTANPLPVATTGVDLDVTLPGEGGKDRPFKVSIKFVSRVSWHLLHEVLTGRTLPEPLELDKPISTNPVHAVDVVLRHLPSMKYTPVGRSFFSAPEGYDHPLGGGREVWFGFHQSVRPAMWKMMLNIDVSATAFYKAQPVIQFMCEVLDIHNIDEQPRPLTDSHRVKFTKEIKGLKVEVTHCGTMRRKYRVCNVTRRPASHQTFPLQLENGQTVERTVAQYFREKYTLQLKYPHLPCLQVGQEQKHTYLPLEVCNIVAGQRCIKKLTDNQTSTMIKATARSAPDRQEEISRLVRSANYETDPFVQEFQFKVRDEMAHVTGRVLPAPMLQYGGRNRTVATPSHGVWDMRGKQFHTGVEIKMWAIACFATQRQCREEILKGFTDQLRKISKDAGMPIQGQPCFCKYAQGADSVEPMFRHLKNTYSGLQLIIVILPGKTPVYAEVKRVGDTLLGMATQCVQVKNVIKTSPQTLSNLCLKINVKLGGINNILVPHQRPSVFQQPVIFLGADVTHPPAGDGKKPSIAAVVGSMDAHPSRYCATVRVQRPRQEIIQDLASMVRELLIQFYKSTRFKPTRIIFYRDGVSEGQFRQVLYYELLAIREACISLEKDYQPGITYIVVQKRHHTRLFCADRTERVGRSGNIPAGTTVDTDITHPYEFDFYLCSHAGIQGTSRPSHYHVLWDDNCFTADELQLLTYQLCHTYVRCTRSVSIPAPAYYAHLVAFRARYHLVDKEHDSAEGSHVSGQSNGRDPQALAKAVQIHQDTLRTMYFA

SEQ ID NO: 857302 - protein, 878 aa, Homo sapiens
DRRRSHRSSTTAGRASSMNGNRLRRPAGAQPLLMVPRRPGYGTMGKPIKLLANCFQVEIPKIDVYLYEVDIKPDKCPRRVNREVVDSMVQHFKVTIFGDRRPVYDGKRSLYTANPLPVATTGVDLDVTLPGEGGKDRPFKVSIKFVSRVSWHLLHEVLTGRTLPEPLELDKPISTNPVHAVDVVLRHLPSMKYTPVGRSFFSAPEGYDHPLGGGREVWFGFHQSVRPAMWKMMLNIDVSATAFYKAQPVIQFMCEVLDIHNIDEQPRPLTDSHRVKFTKEIKGLKVEVTHCGTMRRKYRVCNVTRRPASHQTFPLQLENGQTVERTVAQYFREKYTLQLKYPHLPCLQVGQEQKHTYLPLEVCNIVAGQRCIKKLTDNQTSTMIKATARSAPDRQEEISRLVRSANYETDPFVQEFQFKVRDEMAHVTGRVLPAPMLQYGGRNRTVATPSHGVWDMRGKQFHTGVEIKMWAIACFATQRQCREEILKGFTDQLRKISKDAGMPIQGQPCFCKYAQGADSVEPMFRHLKNTYSGLQLIIVILPGKTPVYAEVKRVGDTLLGMATQCVQVKNVIKTSPQTLSNLCLKINVKLGGINNILVPHQRPSVFQQPVIFLGADVTHPPAGDGKKPSIAAVVGSMDAHPSRYCATVRVQRPRQEIIQDLASMVRELLIQFYKSTRFKPTRIIFYRDGVSEGQFRQVLYYELLAIREACISLEKDYQPGITYIVVQKRHHTRLFCADRTERVGRSGNIPAGTTVDTDITHPYEFDFYLCSHAGIQGTSRPSHYHVLWDDNCFTADELQLLTYQLCHTYVRCTRSVSIPAPAYYAHLVAFRARYHLVDKEHDSAEGSHVSGQSNGRDPQALAKAVQIHQDTLRTMYFA

SEQ ID NO: 857303 - protein, 235 aa, Homo sapiens [sequence omitted]

SEQ ID NO: 857304 - protein, 229 aa, Homo sapiens
MEIGSAGPAGAQPLLMVPRRPGYGTMGKPIKLLANCFQVEIPKIDVYLYEVDIKPDKCPRRVNREVVDSMVQHFKVTIFGDRRPVYDGKRSLYTANPLPVATTGVDLDVTLPGEGGKDRPFKVSIKFVSRVSWHLLHEVLTGRTLPEPLELDKPISTNPVHAVDVVLRHLPSMKYTPVGRSFFSAPEGYDHPLGGGREVWFGFHQSVRPAMWKMMLNIDERDLWQQCGE

SEQ ID NO: 857305 - protein, 860 aa, Homo sapiens; identical to SEQ ID NO: 857301

SEQ ID NO: 857306 - protein, 626 aa, Homo sapiens
MCEVLDIHNIDEQPRPLTDSHRVKFTKEIKGLKVEVTHCGTMRRKYRVCNVTRRPASHQTFPLQLENGQTVERTVAQYFREKYTLQLKYPHLPCLQVGQEQKHTYLPLEVCNIVAGQRCIKKLTDNQTSTMIKATARSAPDRQEEISRLVRSANYETDPFVQEFQFKVRDEMAHVTGRVLPAPMLQYGGRNRTVATPSHGVWDMRGKQFHTGVEIKMWAIACFATQRQCREEILKGFTDQLRKISKDAGMPIQGQPCFCKYAQGADSVEPMFRHLKNTYSGLQLIIVILPGKTPVYAEVKRVGDTLLGMATQCVQVKNVIKTSPQTLSNLCLKINVKLGGINNILVPHQRPSVFQQPVIFLGADVTHPPAGDGKKPSIAAVVGSMDAHPSRYCATVRVQRPRQEIIQDLASMVRELLIQFYKSTRFKPTRIIFYRDGVSEGQFRQVLYYELLAIREACISLEKDYQPGITYIVVQKRHHTRLFCADRTERVGRSGNIPAGTTVDTDITHPYEFDFYLCSHAGIQGTSRPSHYHVLWDDNCFTADELQLLTYQLCHTYVRCTRSVSIPAPAYYAHLVAFRARYHLVDKEHDSAEGSHVSGQSNGRDPQALAKAVQIHQDTLRTMYFA

SEQ ID NO: 857307 - protein, 229 aa, Homo sapiens; identical to SEQ ID NO: 857304

SEQ ID NO: 857308 - protein, 158 aa, Homo sapiens
QRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPVTRPCPISSAIFSPSQRIWAPLLVCFLGLQHHPSEITLPASP

SEQ ID NO: 857309 - protein, 245 aa, Homo sapiens
QRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPCSSLMLIESTRDSLCFTVTHYKHSKQQYSIQAKTVEEKRNWTHHIKRLILENHHATIPQKAKEAILEMDSYYPNRYRCSPERLKKAWSSQDEVSTNVRQGRRQSEPTKHLLRQLNEKARAAGMKVKASG

SEQ ID NO: 857310 - protein, 837 aa, Homo sapiens
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTRPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVAEVVSARIHPEGPPLKFQYEEDELSLELLALASPQPAGDGASEAGTSLVPATAEPPAETPAEIVDGGVPQAQLAGSDSDLDSDDEFVPYDMSGDRELKSSKAPAYVRDCVEALTTSEDIERWEAALRALEGLVYRSPTATREVSVELAKVLLHLEEKTCVVGFAGLRQRALVAVTVTDPAPVADYLTSQFYALNYSLRQRMDILDVLTLAAQELSRPGCLGRTPQPGSPSPNTPCLPEAAVSQPGSAVASDWRVVVEERIRSKTQRLSKGGPRQGPAGSPSRFNSVAGHFFFPLLQRFDRPLVTFDLLGEDQLVLGRLAHTLGALMCLAVNTTVAVAMGKALLEFVWALRFHIDAYVRQGLLSAVSSVLLSLPAARLLEDLMDELLEARSWLADVAEKDPDEDCRTLALRALLLLQRLKNRLLPPASP

SEQ ID NO: 857311 - protein, 837 aa, Homo sapiens; identical to SEQ ID NO: 857310

SEQ ID NO: 857312 - protein, 994 aa, Homo sapiens
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTRPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVAEVVSARIHPEGPPLKFQYEEDELSLELLALASPQPAGDGASEAGTSLVPATAEPPAETPAEIVDGGVPQAQLAGSDSDLDSDDEFVPYDMSGDRELKSSKAPAYVRDCVEALTTSEDIERWEAALRALEGLVYRSPTATREVSVELAKVLLHLEEKTCVVGFAGLRQRALVAVTVTDPAPVADYLTSQFYALNYSLRQRMDILDVLTLAAQELSRPGCLGRTPQPGSPSPNTPCLPEAAVSQPGSAVASDWRVVVEERIRSKTQRLSKGGPRQGPAGSPSRFNSVAGHFFFPLLQRFDRGSVPQDSSVVELCHEAPGICSDAGLVAWPAVPPARARRHHLLGPARLLLPQPALHWPHVQGVRLSRWQRSVGPGLCCSRGGGLGVGNSWPRWTCARQPCRGSRHPEMSAPTISVQARRWAREEGLCGAPSVSHGGPGGWGPGPEAPAAPWAPSCALRPLVTFDLLGEDQLVLGRLAHTLGALMCLAVNTTVAVAMGKALLEFVWALRFHIDAYVRQGLLSAVSSVLLSLPAARLLEDLMDELLEARSWLADVAEKDPDEDCRTLALRALLLLQRLKNRLLPPASP

SEQ ID NO: 857313 - protein, 837 aa, Homo sapiens; identical to SEQ ID NO: 857310

SEQ ID NO: 857314 - protein, 952 aa, Homo sapiens
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTRPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVAEVVSARIHPEGPPLKFQYEEDELSLELLALASPQPAGDGASEAGTSLVPATAEPPAETPAEIVDGGVPQAQLAGSDSDLDSDDEFVPYDMSGDRELKSSKAPAYVRDCVEALTTSEDIERWEAALRALEGLVYRSPTATREVSVELAKVLLHLEEKTCVVGFAGLRQRALVAVTVTDPAPVADYLTSQFYALNYSLRQRMDILDVLTLAAQELSRPGCLGRTPQPGSPSPNTPCLPEAAVSQPGSAVASDWRVVVEERIRSKTQRLSKGGPRQGPAGSPSRFNSVAGHFFFPLLQRFDRGSVPQDSSVVELCHEAPGICSDAGLVAWPAVPPARARRHHLLGPARLLLPQPALHWPHVQGVGSRDGREVWGLGCAAAGVGVSALGTPGPGGLVPDSPAGGVGTRKCLLLRSRCRPLVTFDLLGEDQLVLGRLAHTLGALMCLAVNTTVAVAMGKALLEFVWALRFHIDAYVRQGLLSAVSSVLLSLPAARLLEDLMDELLEARSWLADVAEKDPDEDCRTLALRALLLLQRLKNRLLPPASP

SEQ ID NO: 857315 - protein, 108 aa, Homo sapiens
MKAQLRQSEDGTRGSWLGIGRPGVRPPSVGIGVHALAPPCLQAGLQLWPLTLSCRPEVLSRLLGNLVVKNKKAQFVMTQKLLFLQSRLTVRTPRRVQAAGCPITARMA

SEQ ID NO: 857316 - protein, 96 aa, Homo sapiens
WLTGSLAWYFPNRKCARQGRSVGGLPHSGEWEVWGVVPAELSPRLLAGSYVRQGLLSAVSSVLLSLPAARLLEDLMDELLEARSWLAGECRPAVCV

SEQ ID NO: 857317 - protein, 530 aa, Homo sapiens
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTRPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVAEVVSARIHPEGPPLKFQYEEDELSLELLALASPQPAGDGASEAGTSLVPATAEPPAETPAEIVDGGVPQAQLAGSDSDLDSDDEFVPYDMSGDRELKSSKAPAYVRDCVEGADSGCPGAV

SEQ ID NO: 857318 - protein, 470 aa, Homo sapiens
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTRPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVAEVVSARIHPEGPPLKFQYEEDELSLELLALASPKHSWRALTRTWTAMMSLSPTTCRGTES

SEQ ID NO: 857319 - protein, 837 aa, Homo sapiens; identical to SEQ ID NO: 857310

SEQ ID NO: 857320 - protein, 804 aa, Homo sapiens
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTRPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVAEVVSARIHPEGPPLKFQYEEDELSLELLALASPQPAGDGASEAGTSLVPATAEPPAETPAEIVDGGVPQAQLAGSDSDLDSDDEFVPYDMSGDRELKSSKAPAYVRDCVEALTTSEDIERWEAALRALEGLVYRSPTATREVSVELAKVLLHLEEKTCVVGFAGLRQRALVAVTVTDPAPVADYLTSQFYALNYSLRQRMDILDVLTLAAQELSRPGCLGRTPQPGSPSPNTPCLPEAAVSQPGSAVASDWRVVVEERIRSKTQRLSKGGPRQGPAGSPSRFNSVAGHFFFPLLQRFDRPLVTFDLLGEDQLVLGRLAHTLGALMCLAVNTTVAVAMGKALLEFVWALRFHIDAYVRQGLLSAVSSVLLSLPAARLLEDLMDELLSENKLLYWN

SEQ ID NO: 857321 - protein, 68 aa, Homo sapiens
VADYLTSQFYALNYSLRQRMDILDVSASWASVPLVWPKLPKVGLPKPGSPCCWAPRARAGLSTAFVSV

SEQ ID NO: 857322 - protein, 747 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 857323 - protein, 790 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEEGQNSQSPQCFKTCSEQNGYVLTLSNAQPVLQYGNPYASQETRDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 857324 - protein, 747 aa, Homo sapiens; identical to SEQ ID NO: 857322

SEQ ID NO: 857325 - protein, 747 aa, Homo sapiens; identical to SEQ ID NO: 857322

SEQ ID NO: 857326 - protein, 671 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEEGQNSQSPQCFKTCSELILMHLRKQEMEQMVLFTQMKYKGHLSESPLGDWKTMLSAASLLETLVGLMA

SEQ ID NO: 857327 - protein, 697 aa, Homo sapiens
MTFQVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 857328 - protein, 590 aa, Homo sapiens
MKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 857329 - protein, 703 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEDGADGAFYPDEIQRPPVRVPSWGLEDNVVCSQPARNFSRPDGLEDSEDSKEDENVPTAPDPPSQHLRGHGTGFCFDSRGSINGLHNCLQQAFRSREMFLE

SEQ ID NO: 857330 - protein, 614 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEGKKKKKKPHLK

SEQ ID NO: 857331 - protein, 221 aa, Homo sapiens [sequence omitted]

SEQ ID NO: 857332 - protein, 264 aa, Homo sapiens
MTKEIADKTEKYNKCKQLLQDEKAKCNKYADELAKMELKWKEQVKIAENVKLELAEVQDNYKELKRSLENPAERKMEEGQNSQSPQCFKTCSEQNGYVLTLSNAQPVLQYGNPYASQETRDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 857333 - protein, 747 aa, Homo sapiens; identical to SEQ ID NO: 857322

SEQ ID NO: 857334 - protein, 343 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKGRYLFFKGATS

SEQ ID NO: 857335 - protein, 646 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEEGQNSQSPQCFKTCSEQNGYVLTLSNAQPVLQYGWSRWCFLPR

SEQ ID NO: 857336 - protein, 682 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 857337 - protein, 703 aa, Homo sapiens; identical to SEQ ID NO: 857329

SEQ ID NO: 857338 - protein, 703 aa, Homo sapiens; identical to SEQ ID NO: 857329

SEQ ID NO: 857339 - protein, 250 aa, Homo sapiens
KQAGTAVDKPSPSAAEADFDIVTKGQVCEMTKEIADKTEKYNKCKQLLQDEKAKCNKYADELAKMELKWKEQVKIAENVKLELAEVQDNYKELKRSLENPAERKMEDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 857340 - protein, 215 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKEPENHQGRTTI

SEQ ID NO: 857341 - protein, 392 aa, Homo sapiens
MQKWFSAFDDAIIQRQWRANPSRGGGGVSFTKEVDTNVATGAPPRRQRVPGRACPWREPIRGRRGARPGGGDAGMCVATALPALTGLRDDKLTLLSSSPGLGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 857342 - protein, 109 aa, Homo sapiens [sequence omitted]

SEQ ID NO: 857343 - protein, 188 aa, Homo sapiens
LIRLFSLSSLWRQKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 857344 - protein, 280 aa, Homo sapiens
MQKWFSAFDDAIIQRQWRANPSRGGGGVSFTKEVDTNVATGAPPRRQRVPGRACPWREPIRGRRGARPGGGDAGMCVATALPALTGLRDDKLTLLSSSPGLGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRASGECWSPHRPRCWELVASCAWSWEIHQVLC

SEQ ID NO: 857345 - protein, 268 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEIT

SEQ ID NO: 857346 - protein, 364 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 857347 - protein, 241 aa, Homo sapiens
RVLLEPRPRPSSLSVSRFICRSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 857348 - protein, 268 aa, Homo sapiens; identical to SEQ ID NO: 857345

SEQ ID NO: 857349 - protein, 295 aa, Homo sapiens
RVLLEPRPRPSSLSVSRFICRSARAAVSELMQLFPRGLFEDALPPIVLRSQVYSLVPDRTVADRQLVRGVGATAGSPFPNSWNSLSLSHSASRSASIRPFRRGHCARHWGATETLLKVPQKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 857350 - protein, 145 aa, Homo sapiens
RVLLEPRPRPSSLSVSRFICRSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEIT

SEQ ID NO: 857351 - protein, 677 aa, Homo sapiens
QTVIRSLNRTDFHGSGYTSMAIIYGVFSASNLITPSVVAIVGPQLSMFASGLFYSMYIAVFIQPFPWSLTRTQTSRPESPGMTSPSPRIQIISTDSAVASPQRIQIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 857352 - protein, 595 aa, Homo sapiens
RGGGGWEGEGKVFCNDALLQRYNIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 857353 - protein, 628 aa, Homo sapiens
MTSPSPRIQIISTDSAVASPQRIQGSEPASGPLSVFTSLNKEKIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQRTGIHSTHNIPPGNPLWSGLRPGWNKLPSAGWGLTHLGPSVHEVHPEIPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 857354 - protein, 220 aa, Homo sapiens
MPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 857355 - protein, 376 aa, Homo sapiens
MTSPSPRIQIISTDSAVASPQRIQGSEPASGPLSVFTSLNKEKIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQRTGIHSTHNIPPGNPLWSGLRPGWNKLPSAGWGLTHLGPSVHEVHPEIPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRYEPMRMESPLLAWTPSLYCEGGKQHFGTCAVFN

SEQ ID NO: 857356 - protein, 689 aa, Homo sapiens
EFAAPTSASRLSPAAPRARGPRLPPSADTGSPGSPRPALRAGGRPPQTRDPLRGRFGANPEVTRTQTSRPESPGMTSPSPRIQIISTDSAVASPQRIQGSEPASGPLSVFTSLNKEKIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 857357 - protein, 159 aa, Homo sapiens
MSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 857358 - protein, 607 aa, Homo sapiens
RGGGGWEGEGKVFCNDALLQRYNIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRSNQTTHSFFPKIFLMCSMISLLLLVSTSTRTCSPESGNGKHGAEEKQNSQRTQPQKVVIWDLLLVAETF

SEQ ID NO: 857359 - protein, 34 aa, Homo sapiens
MSQITLQSGTREQLQQFQLVCYRVIHKHALLLNN

SEQ ID NO: 857360 - protein, 632 aa, Homo sapiens
GGGAGPPPSRAGVGRRAWRPRTETAVPDPRAGAERAEAGAMEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 857361 - protein, 595 aa, Homo sapiens
GGGAGPPPSRAGVGRRAWRPRTETAVPDPRAGAERAEAGAMEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 857362 - protein, 632 aa, Homo sapiens; identical to SEQ ID NO: 857360

SEQ ID NO: 857363 - protein, 654 aa, Homo sapiens
ITSSARSSPLPVNSGALSLSFSFSSSSSLSPNCCTPATASPQAPFRLWTKLFAMSTTLVILLACLHGSTHPFPYRVSQPTHSPCTPHPGFIHGGCTLAFGMGQVLHLANAVPRNKMTVSSFPFPIPDATDVSAESQPTPRPPLPGHTPSISECPDLCSNCLMNQGPICVLIILPCSIPLHTSALAYSGGIAASGYTPPMAEVLWRIRSTLCPPHSTCILHSTLALGGVQLEVCVSSAREWMGPGELVSSPRGAPDGCVLWVSSFPSLGYSPVAGLSIWDSTQGSSALSLLAFQIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 857364 - protein, 82 aa, Homo sapiens
GGGAGPPPSRAGVGRRAWRPRTETAVPDPRAGAERAEAGAMEKARPLWANSLQFVFACISYAVGLGNVWRFPYLCQMYGGVM

SEQ ID NO: 857365 - protein, 569 aa, Homo sapiens
GGGAGPPPSRAGVGRRAWRPRTETAVPDPRAGAERAEAGAMEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSHRARLKIFLNCNKYSAFFLMKMNFVYQ

SEQ ID NO: 857366 - protein, 185 aa, Homo sapiens
TCVSTESKEALYLVISRAGHRYHCGPYTRFISISSSSCSRPPSPFGCCCTLECELQKSPKIPDRQHILCRPSKPSAASKIKAQLLNSVQCATSNLFICSLHLQFSVIPKPHPCKALYSAPQMISRQLRSLSCLCPALFPGTSSFIVALSSPANLYIPQRQRSDELVFESQKGSAMELAVITVDGV

SEQ ID NO: 857367 - protein, 264 aa, Homo sapiens
RSAGPPLLAGTAAPPAQPLAKKKVVKRRADTTTPTPTAILAPGSPASPPGSLEPKAARLPPMRRESGRPIKPPRKDLPDSQQQHQSSKKGKLSEQLKHCNGILKELLSKKHAAYAWPFYKPVDLLHLACMTTMTSLSTPWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVCAFLSLGPGVK

SEQ ID NO: 857368 - protein, 247 aa, Homo sapiens
MQGGNSGVRKREEEGDGAGAVAAPPAIDFPAEGPDPEYDVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIEWHTLKLHPDQGEDRKHGGSA

SEQ ID NO: 857369 - protein, 630 aa, Homo sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 857370 - protein, 630 aa, Homo sapiens; identical to SEQ ID NO: 857369

SEQ ID NO: 857371 - protein, 630 aa, Homo sapiens; identical to SEQ ID NO: 857369

SEQ ID NO: 857372 - protein, 502 aa, Homo sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKSKFLVLFCFLCISKRHGCTC

SEQ ID NO: 857373 - protein, 648 aa, Homo sapiens
MRRWVDSMCAPRSGGPVMQQKSEVDGCLLLVDVRSLYVSSLNVSPLPTWPGCTSEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 857374 - protein, 662 aa, Homo sapiens
MQGGNSGVRKREEEGDGAGAVAAPPAIDFPAEGPDPEYDEMWSCCVSQAGLERLASSDSPASAFQNAVDYRESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 857375 - protein, 506 aa, Homo sapiens
MNQTHFVQDRCLSDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 857376 - protein, 630 aa, Homo sapiens; identical to SEQ ID NO: 857369

SEQ ID NO: 857377 - protein, 602 aa, Homo sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQER

SEQ ID NO: 857378 - protein, 630 aa, Homo sapiens; identical to SEQ ID NO: 857369

SEQ ID NO: 857379 - protein, 630 aa, Homo sapiens; identical to SEQ ID NO: 857369

SEQ ID NO: 857380 - protein, 196 aa, Homo sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVVFHVLVLTYYPK

SEQ ID NO: 857381 - protein, 630 aa, Homo sapiens; identical to SEQ ID NO: 857369

SEQ ID NO: 857382 - protein, 630 aa, Homo sapiens; identical to SEQ ID NO: 857369

SEQ ID NO: 857383 - protein, 630 aa, Homo sapiens; identical to SEQ ID NO: 857369

SEQ ID NO: 857384 - protein, 101 aa, Homo sapiens
QVTLAGSLQGERTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 857385 - protein, 185 aa, Homo sapiens; identical to SEQ ID NO: 857366

SEQ ID NO: 857386 - protein, 381 aa, Homo sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEVDYFPRPS

SEQ ID NO: 857387 - protein, 532 aa, Homo sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACLMYMATCRKQQHLHRLVRRCVTYTNMTNWATENLTPLKYPLPGLLPSKYKIGDYGSGLNRNPYRSTRTDQQTPGQTTTTTSSEGTHADAKPQRASTEKNHQKEQAVPQTHTSTKRTKSTST

SEQ ID NO: 857388 - protein, 247 aa, Homo sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKQVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 857389 - protein, 630 aa, Homo sapiens; identical to SEQ ID NO: 857369

SEQ ID NO: 857390 - protein, 630 aa, Homo sapiens; identical to SEQ ID NO: 857369

SEQ ID NO: 857391 - protein, 630 aa, Homo sapiens; identical to SEQ ID NO: 857369

SEQ ID NO: 857392 - protein, 630 aa, Homo sapiens; identical to SEQ ID NO: 857369

SEQ ID NO: 857393 - protein, 624 aa, Homo sapiens
CESLEDPAHAVGGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 857394 - protein, 567 aa, Homo sapiens
LERWSPVDEPKPNIASPTRCLQSSYSRKSVLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 857395 - protein, 422 aa, Homo sapiens
MKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 857396 - protein, 630 aa, Homo sapiens; identical to SEQ ID NO: 857369

SEQ ID NO: 857397 - protein, 196 aa, Homo sapiens; identical to SEQ ID NO: 857380

SEQ ID NO: 857398 - protein, 195 aa, Homo sapiens [sequence omitted]

SEQ ID NO: 857399 - protein, 630 aa, Homo sapiens; identical to SEQ ID NO: 857369

SEQ ID NO: 857400 - protein, 294 aa, Homo sapiens
RSAGPPLLAGTAAPPAQPLAKKKVVKRRADTTTPTPTAILAPGSPASPPGSLEPKAARLPPMRRESGRPIKPPRKDLPDSQQQHQSSKKGKLSEQLKHCNGILKELLSKKHAAYAWPFYKPVDLLHLACMTTMTSLSTPWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 857401 - protein, 155 aa, Homo sapiens
EGSEYDANCSGEAYRQVPTLDASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 857402 - protein, 630 aa, Homo sapiens; identical to SEQ ID NO: 857369

SEQ ID NO: 857403 - protein, 1002 aa, Homo sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPFMFMAHHVANNTHFSKHIGQQQVCSTITVNQWAIVHRSICKPKQHHYVYPWRPASRPRYTHIKRSTYRILALATQPPIPHSTATDTGTKDTNTRHTPAAQQQHDTNNTINRYTQHAMETNTIMTSWSHRHLYTTHGRHTGGDGKAAIHWTDTCTCHNTDTAGQYHGLAKTILTRNGLRIHLGPKGTDNSNKDNETRRTWENNHRNKHGARHRQGSERNNAIITIQKPTGRIRLQEEQNIDEKSTSNSRTHGDNKYPKSPTERAKRGLDSTTERKKPNPNKNTIALTTTDTTTNNHGQGPRRTTRTQDTGPKTSKPQHTYGGTITQTRWPGHQQRHHHIANPTTNNYHRSKNSEHITRTKPTVAKAHGHKQQTHHDSQREKTTHQIGKQTLQPEQQHQNKHPNTTYINTDRHRRTITSKLEQQPQQQRRQMTTNNNKNTIKTPNKKTLNSTKRTQHTHDDTNYESTRQEEQKNQDDGQQRKADIYDKGRTTQMTGRATERQTGDAHERRAEHRATHDQDARHIECHEEHKQNQTDRRTRETLNSNNQVESTASYSRTQTHRNEQDNSRVKEERWTAHRERHDTRIDDETPP

SEQ ID NO: 857404 - protein, 68 aa, Homo sapiens
VGGPSEMPTDGEGNIARFLFSLGQKHNAVNATLIDSWVDIAIFQLKEGSSKEKAAVFRSMNSLLSIST

SEQ ID NO: 857405 - protein, 119 aa, Homo sapiens
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEDKKTYGEIFEKFHPIR

SEQ ID NO: 857406 - protein, 119 aa, Homo sapiens
TLAGSDLETTLALPDEARSLPPPKLTDPRLLYIGFLGYCSGLIDNLIRRRPIATAGLHRQLLYITAFFFAGYYLVKREDYLYAVRDREMFGYMKLHPEDFPEEDKKTYGEIFEKFHPIR

SEQ ID NO: 857407 - protein, 119 aa, Homo sapiens; identical to SEQ ID NO: 857405

SEQ ID NO: 857408 - protein, 119 aa, Homo sapiens; identical to SEQ ID NO: 857405

SEQ ID NO: 857409 - protein, 119 aa, Homo sapiens; identical to SEQ ID NO: 857405

SEQ ID NO: 857410 - protein, 119 aa, Homo sapiens; identical to SEQ ID NO: 857405

SEQ ID NO: 857411 - protein, 103 aa, Homo sapiens
MIARRNPEPLRFLPDEARSLPPPKLTDPRLLYIGFLGYCSGLIDNLIRRRPIATAGLHRQLLYITAFFFAGYYLVKMKLHPEDFPEEDKKTYGEIFEKFHPIR

SEQ ID NO: 857412 - protein, 178 aa, Homo sapiens
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEDVYFVELNVGGEFHTTTLGTLRKFPGSKLAEMFSSLAKASTDAEGRFFIDRPSTYFRPILDYLRTGQVPTQHIPE

SEQ ID NO: 857413 - protein, 119 aa, Homo sapiens; identical to SEQ ID NO: 857405

SEQ ID NO: 857414 - protein, 119 aa, Homo sapiens; identical to SEQ ID NO: 857405

SEQ ID NO: 857415 - protein, 119 aa, Homo sapiens; identical to SEQ ID NO: 857405

SEQ ID NO: 857416 - protein, 119 aa, Homo sapiens; identical to SEQ ID NO: 857405

SEQ ID NO: 857417 - protein, 275 aa, Homo sapiens
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEDKKTYGEILYIQKLPPPPLTKKPIKITKTKHKPTHSPNTKPTTHNHFHRRRPPPVHTTAALPTPPPPPPPSPAPQQRATNRTAPPHMAAPLSITPPCISDTILNRIPLMRQSPVDFHPSSSTLIIPPTHSTQHPYLLHLSFLLISLNLISQLVLLAIACLKSTPPPIHLLHN

SEQ ID NO: 857418 - protein, 513 aa, Homo sapiens
AGGRASGIRLAQLTAPENGRGGAPVEQGVSRPGRLAAVLMSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 857419 - protein, 141 aa, Homo sapiens
MSSEDREAQEDELLALASIYDGDEFRKAESVQGGETRIYLDLPQNFKIFVSEKLMDLRNEYLQADEANKRLLDQRYGKRVIQKALEEMESKEWLEKNSKSCPCCGTPIEWICMGSLSRANPYKHFNDPGSPCFNRYVYTEF

SEQ ID NO: 857420 - protein, 47 aa, Homo sapiens
MSSEDREAQEDELLALASIYDGDEFRKEFQDFVSGNSECLQNSGFVH

SEQ ID NO: 857421 - protein, 118 aa, Homo sapiens
YWWCWLECSVSVLVALASIYDGDEFRKAESVQGGETRIYLDLPQNFKIFVSGNSNECLQNSGFEYTICFLPPLVLNFELPPDYPSSSPPSFTLSGKWLSPTQLSAICKHHQYRQHHQY

SEQ ID NO: 857422 - protein, 474 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 857423 - protein, 474 aa, Homo sapiens; identical to SEQ ID NO: 857422

SEQ ID NO: 857424 - protein, 498 aa, Homo sapiens
AWASSLFSSRRGLWSPLSEHSEVLMSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 857425 - protein, 474 aa, Homo sapiens; identical to SEQ ID NO: 857422

SEQ ID NO: 857426 - protein, 474 aa, Homo sapiens; identical to SEQ ID NO: 857422

SEQ ID NO: 857427 - protein, 474 aa, Homo sapiens; identical to SEQ ID NO: 857422

SEQ ID NO: 857428 - protein, 513 aa, Homo sapiens; identical to SEQ ID NO: 857418

SEQ ID NO: 857429 - protein, 510 aa, Homo sapiens
LRRMRPGLRGQARWEAAVHAARRLLREREPLHHQVLMSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 857430 - protein, 498 aa, Homo sapiens; identical to SEQ ID NO: 857424

SEQ ID NO: 857431 - protein, 172 aa, Homo sapiens
MADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 857432 - protein, 171 aa, Homo sapiens
MSSEDREAQEDELLALASIYDGDEFRKAESVQGGETRIYLDLPQNFKIFVSEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 857433 - protein, 117 aa, Homo sapiens [sequence omitted]

SEQ ID NO: 857434 - protein, 139 aa, Homo sapiens
ESLSNLIQEILDFDQAQQIKCFNSKLFLCSICFCEKLGSECMYFLECRHVYCKACLKDYFEIQIRDGQVQCLNCPEPKCPSVATPGQVTVYPADGCLLILFHKWRYHLRNFLDRAHGAVRGLGASPQVVLLYPLKMLWS

SEQ ID NO: 857435 - protein, 474 aa, Homo sapiens; identical to SEQ ID NO: 857422

SEQ ID NO: 857436 - protein, 127 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQSAFLLLCQALENNPYGEKPTVGNRG

SEQ ID NO: 857437 - protein, 498 aa, Homo sapiens; identical to SEQ ID NO: 857424

SEQ ID NO: 857438 - protein, 474 aa, Homo sapiens; identical to SEQ ID NO: 857422

SEQ ID NO: 857439 - protein, 348 aa, Homo sapiens
MQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 857440 - protein, 498 aa, Homo sapiens; identical to SEQ ID NO: 857424

SEQ ID NO: 857441 - protein, 474 aa, Homo sapiens; identical to SEQ ID NO: 857422

SEQ ID NO: 857442 - protein, 298 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 857443 - protein, 238 aa, Homo sapiens
LKTCYVEEIRGVVLEDRHLWNDSHPLKLGGWRPASLRSWGWVVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 857444 - protein, 124 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDTRRTVTWLLLMHL

SEQ ID NO: 857445 - protein, 987 aa, Homo sapiens
MVCSPVTVRIAPPDRRFSRSAIPEQIISSTLSSPSSNAPDPCAKETVLSALKEKKKKRTVEEEDQIFLDGQENKRRRHDSSGSGHSAFEPLVASGVPASFVPKPGSLKRGLNSQSSDDHLNKRSRSSSMSSLTGAYTSGIPSSSRNAITSYNSSTRGISQLWKRNGPSSSPFSSPASSRSQTPERPAKKIREEELCHHSSSSTPLAADKESQGEKAADTTPRKKQNSNSQSTPGSSGQRKRKVQLLPSRRGEQLTLPPPPQLGYSITAEDLDLEKKASLQWFNQALEDKSDAASNSVTETPPTTQPSFTFTLPAAATASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSASPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLPTAVPTATSSSAADFSGFGSTLATSAPATSSQPTLTFSNTSTPTFNIPFGSSAKSPLPSYPGANPQPAFGAAEGQPPGAAKPALTPSFGSSFTFGNSAAPAPATAPTPAPASTIKIVPAHVPTPIQPTFGGATHSAFGLKATASAFGAPASSQPAFGGSTAVFSFGAATSSGFGATTQTASSGSSSSVFGSTTPSPFTFGGSAAPAGSGSFGINVATPGSSATTGAFSFGAGQSGSTATSTPFTGGLGQNALGTTGQSTPFAFNVGSTTESKPVFGGTATPTFGQNTPAPGVGTSGSSLSFGASSAPAQGFVGVGPFGSAAPSFSIGAGSKTPGARQRLQARRQHTRKK

SEQ ID NO: 857446 - protein, 649 aa, Homo sapiens
MQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSASPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLPTAVPTATSSSAADFSGFGSTLATSAPATSSQPTLTFSNTSTPTFNIPFGSSAKSPLPSYPGANPQPAFGAAEGQPPGAAKPALTPSFGSSFTFGNSAAPAPATAPTPAPASTIKIVPAHVPTPIQPTFGGATHSAFGLKATASAFGAPASSQPAFGGSTAVFSFGAATSSGFGATTQTASSGSSSSVFGSTTPSPFTFGGSAAPAGSGSFGINVATPGSSATTGAFSFGAGQSGSTATSTPFTGGLGQNALGTTGQSTPFAFNVGSTTESKPVFGGTATPTFGQNTPAPGVGTSGSSLSFGASSAPAQGFVGVGPFGSAAPSFSIGAGSKTPGARQRLQARRQHTRKK

SEQ ID NO: 857447 - protein, 987 aa, Homo sapiens; identical to SEQ ID NO: 857445

SEQ ID NO: 857448 - protein, 899 aa, Homo sapiens
MLPSIKHLTVFSFIRPGSLKRGLNSQSSDDHLNKRSRSSSMSSLTGAYTSGIPSSSRNAITSYNSSTRGISQLWKRNGPSSSPFSSPASSRSQTPERPAKKIREEELCHHSSSSTPLAADKESQGEKAADTTPRKKQNSNSQSTPGSSGQRKRKVQLLPSRRGEQLTLPPPPQLGYSITAEDLDLEKKASLQWFNQALEDKSDAASNSVTETPPTTQPSFTFTLPAAATASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSASPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLPTAVPTATSSSAADFSGFGSTLATSAPATSSQPTLTFSNTSTPTFNIPFGSSAKSPLPSYPGANPQPAFGAAEGQPPGAAKPALTPSFGSSFTFGNSAAPAPATAPTPAPASTIKIVPAHVPTPIQPTFGGATHSAFGLKATASAFGAPASSQPAFGGSTAVFSFGAATSSGFGATTQTASSGSSSSVFGSTTPSPFTFGGSAAPAGSGSFGINVATPGSSATTGAFSFGAGQSGSTATSTPFTGGLGQNALGTTGQSTPFAFNVGSTTESKPVFGGTATPTFGQNTPAPGVGTSGSSLSFGASSAPAQGFVGVGPFGSAAPSFSIGAGSKTPGARQRLQARRQHTRKK

SEQ ID NO: 857449 - protein, 987 aa, Homo sapiens; identical to SEQ ID NO: 857445

SEQ ID NO: 857450 - protein, 312 aa, Homo sapiens
MVCSPVTVRIAPPDRRFSRSAIPEQIISSTLSSPSSNAPDPCAKETVLSALKEKKKKRTVEEEDQIFLDGQENKRRRHDSSGSGHSAFEPLVASGVPASFVPKPGSLKRGLNSQSSDDHLNKRSRSSSMSSLTGAYTSGIPSSSRNAITSYNSSTRGISQLWKRNGPSSSPFSSPASSRSQTPERPAKKIREEELCHHSSSSTPLAADKESQGEKAADTTPRKKQNSNSQSTPGSSGQRKRKVQLLPSRRGEQLTLVWSCPSTPALPGLALLSLRNAKDKFLLVFFLTYFCFCFLRQHPSVTQAGVQWLDFG

SEQ ID NO: 857451 - protein, 282 aa, Homo sapiens
PTLGHTRKRRRRPSGKMAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLAGTIRAREPS

SEQ ID NO: 857452 - protein, 92 aa, Homo sapiens
IRGRVDLRADDDGGTGRNEMGVKLEIFRMIIYLTFPVAMFWVSNQAEWFEDDVIQRKRELWPPEKLQEIEEFKERLRKRREEKLLRDAQQNS

SEQ ID NO: 857453 - protein, 129 aa, Homo sapiens
MARYEAGWSGWTPVIKDVMEDAVEDRLDRNLWPFVSDPAPTASSQAAVSARFGHWHKNKAGVEARAGPRLIVYVMGGVAMSEMRAAYEVTRATEGKWEVLIGSSHILTPTRFLDDLKALDKKLEDIALP

SEQ ID NO: 857454 - protein, 247 aa, Homo sapiens
MERHHKNKHTNKEGEGGAPKNTIPQEGAPTTAAHPLPRRQAAPHTGAAPHKTPRRDARRPKQPPTPENGEHTTPPRAGHTGTTDRPHNSEGGTSNDIVGRQQPPPQRRIFSPRSSARAHNIPHLPLDGETNTLRGRDTQHPHTRSTTSCGAEVNKPRILRHSPRERKRSYYPSHKTTHIIITTTPARTRCSKCTNTTISRPLEHTQLTETTDRQQSHSHSERRKQISPIRLSLPPVTTKPHIQNQPN

SEQ ID NO: 857455 - protein, 105 aa, Homo sapiens
MEPTYQLSRWTPVIKDVMEDAVEDRLDRNLWPFVSDPAPTASSQAAVSARFGHWHKNKAGVEARAGPRLIVYVMGGVAMSEMRAAYEVTRATEGKWEVLIRLQQH

SEQ ID NO: 857456 - protein, 89 aa, Homo sapiens
GTSSCRIGTRLTGRNEMGVKLEIFRMIIYLTFPVAMFWVSNQAEWFEDDVIQRKRELWPPEKLQEIEEFKERLRKRREEKLLRDAQQNS

SEQ ID NO: 857457 - protein, 924 aa, Homo sapiens
PTLGHTRKRRRRPSGKMAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGVRQERAWGDPGRGCGSQPGLCKADGPSGAQARCGSWRGVVAGRPKAVFRVWSGAQRTLGPLPVPAYTIGRGSETWSLPGWSWQWCSWERVVWVLEAGSRVPSMGATPHCLSGLPGVSEGPPHPSSTHTQPCVCLTLGSASPVSLWPCASPSRVPSPRPHLSPIPHPSRCALFLHISLSHPSLCLPLSLCSLSCSPPLSVPLLSPSSSLCFLLHLLSLSLPSYFVSLLLISLPISASVFVFLWLALSPFGFLSPSLSGSLFLSLAFLLSLALSRSLFHFPIFACHPPPYQPHQAQPLCDQPPSPQSPCCPPCPACEGSGTSSRLEPRERMEPTYQLSRWTPVIKDVMEDAVEDRLDRNLWPFVSDPAPTASSQAAVSARFGHWHKNKAGVEARAGPRLIVYVMGGVAMSEMRAAYEVTRATEGKWEVLIGSSHILTPTRFLDDLKALDKKLEDIALP

SEQ ID NO: 857458 - protein, 644 aa, Homo sapiens
PTLGHTRKRRRRPSGKMAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSEAPGPPPPTPGSVLGGRPGSGEGLLPGLSAPALHSARFGHWHKNKAGVEARAGPRLIVYVMGGVAMSEMRAAYEVTRATEGKWEVLIGSSHILTPTRFLDDLKALDKKLEDIALP

SEQ ID NO: 857459 - protein, 561 aa, Homo sapiens [sequence omitted]

SEQ ID NO: 857460 - protein, 571 aa, Homo sapiens
PPKSNCRQFLCSCPLGLPKLVPDNSLGLEEAIHQFVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGVEARAGPRLIVYVMGGVAMSEMRAAYEVTRATEGKWEVLIGSSHILTPTRFLDDLKALDKKLEDIALP

SEQ ID NO: 857461 - protein, 559 aa, Homo sapiens
PTLGHTRKRRRRPSGKMAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGVRQERAWGDPGRGCGSQPGLCKADGPSGAQARCGSWRGVVAGRPKAVFRVWSGAQRTLGPLPVPAYTIGRGSETWSLPGWSWQWCSWERVV

SEQ ID NO: 857462 - protein, 361 aa, Homo sapiens [sequence omitted]

SEQ ID NO: 857463 - protein, 346 aa, Homo sapiens
SVLEVPRKGDIEGGHEYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGVEARAGPRLIVYVMGGVAMSEMRAAYEVTRATEGKWEVLIGSSHILTPTRFLDDLKALDKKLEDIALP

SEQ ID NO: 857464 - protein, 85 aa, Homo sapiens
MSSSALLSLRNEMGVKLEIFRMIIYLTFPVAMFWVSNQAEWFEDDVIQRKRELWPPEKLQEIEEFKERLRKRREEKLLRDAQQNS

SEQ ID NO: 857465 - protein, 536 aa, Homo sapiens
MGSDAEGEKIKDSMKLIVPVLLDAAVPAYDKIRVLLLYILLRNGVSEENLAKLIQHANVQAHSSLIRNLEQLGGTVTNPGVRQERAWGDPGRGCGSQPGLCKADGPSGAQARCGSWRGVVAGRPKAVFRVWSGAQRTLGPLPVPAYTIGRGSETWSLPGWSWQWCSWERVVWVLEAGSRVPSMGATPHCLSGLPGVSEGPPHPSSTHTQPCVCLTLGSASPVSLWPCASPSRVPSPRPHLSPIPHPSRCALFLHISLSHPSLCLPLSLCSLSCSPPLSVPLLSPSSSLCFLLHLLSLSLPSYFVSLLLISLPISASVFVFLWLALSPFGFLSPSLSGSLFLSLAFLLSLALSRSLFHFPIFACHPPPYQPHQAQPLCDQPPSPQSPCCPPCPACEGSGTSSRLEPRERMEPTYQLSRWTPVIKDVMEDAVEDRLDRNLWPFVSDPAPTASSQAAVSARFGHWHKNKAGVEARAGPRLIVYVMGGVAMSEMRAAYEVTRATEGKWEVLIGSSHILTPTRFLDDLKALDKKLEDIALP

SEQ ID NO: 857466 - protein, 247 aa, Homo sapiens; identical to SEQ ID NO: 857454

SEQ ID NO: 857467 - protein, 68 aa, Homo sapiens
MSSSALLSLRNEMGVKLEIFRMIIYLTFPVAMFWVSNQAEWFEDDVIQRKRELWPPEKAMSKEPRAEE

SEQ ID NO: 857468 - protein, 80 aa, Homo sapiens
MSSSALLSLRNEMGVKLEIFRMIIYLTFPVAMFWVSNQAEWFEDDVIQRKRELWPPEKVSDLFFLPEGWRRLDSCIRDGF

SEQ ID NO: 857469 - protein, 609 aa, Homo sapiens
PTLGHTRKRRRRPSGKMAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGVEARAGPRLIVYVMGGVAMSEMRAAYEVTRATEGKWEVLIGSSHILTPTRFLDDLKALDKKLEDIALP

SEQ ID NO: 857470 - protein, 89 aa, Homo sapiens
EGRLWAELALLTGRNEMGVKLEIFRMIIYLTFPVAMFWVSNQAEWFEDDVIQRKRELWPPEKLQEIEEFKERLRKRREEKLLRDAQQNS

SEQ ID NO: 857471 - protein, 89 aa, Homo sapiens; identical to SEQ ID NO: 857470

SEQ ID NO: 857472 - protein, 68 aa, Homo sapiens
PHLGTHPEAAAAPLGEDGALGAEGGGGGKNSERSYSECQEGWGVEGAYHGSPKHAHLVFLLQNVRYPG

SEQ ID NO: 857473 - protein, 92 aa, Homo sapiens; identical to SEQ ID NO: 857452

SEQ ID NO: 857474 - protein, 619 aa, Homo sapiens
PTLGHTRKRRRRPSGKMAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGVEARAGPRLIVYVMGGVAMSEMRAAYEVTRATEGKWEVLIGKSPGLGPWALGLGFPGPGLVPSRCLDSRVLGVRDLVC

SEQ ID NO: 857475 - protein, 542 aa, Homo sapiens
PTLGHTRKRRRRPSGKMAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVAPHTSSPRPASWMT

SEQ ID NO: 857476 - protein, 718 aa, Homo sapiens
MRVHVHVCVCLHACDCMCACVYVCMCPCVCVCMCVHVCVHLCMHVCACLHVCLCMCLCACACVCVCVCICVCVCMRVCMRLCMCVCVCVRISVCMCVYVCMYVCARICVCACVYVCVCISVCACVYVCVHLCVCACVHACVCVCACVHLCVCACAHVGATLVCICTYTCPRPSMFAHGGRWGVAGRPRQPMSLGVQAQAQRVIHLPQSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGVEARAGPRLIVYVMGGVAMSEMRAAYEVTRATEGKWEVLIGSSHILTPTRFLDDLKALDKKLEDIALP

SEQ ID NO: 857477 - protein, 478 aa, Homo sapiens
YRLGTRLCGDIGRGLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGVEARAGPRLIVYVMGGVAMSEMRAAYEVTRATEGKWEVLIGSSHILTPTRFLDDLKALDKKLEDIALP

SEQ ID NO: 857478 - protein, 410 aa, Homo sapiens
MSPVSDLPARGPEDTAQLAHAVLAKLNAFKADTPSLGEGPEKTRSQLLIMDRAADPVSPLLHELTFQAMAYDLLDIEQDTYRYETTGLSEAREKAVLLDEDDDLWVELRHMHIADVSKKVTELLRTFCESKRLTTDKANIKDLSQILKKMPQYQKELNKYSTHLHLADDCMKHFKGSVEKLCSVEQDLAMGSDAEGEKIKDSMKLIVPVLLDAAVPAYDKIRVLLLYILLRNGVSEENLAKLIQHANVQAHSSLIRNLEQLGGTVTNPGGSGTSSRLEPRERMEPTYQLSRWTPVIKDVMEDAVEDRLDRNLWPFVSDPAPTASSQAAVSARFGHWHKNKAGVEARAGPRLIVYVMGGVAMSEMRAAYEVTRATEGKWEVLIGSSHILTPTRFLDDLKALDKKLEDIALP

SEQ ID NO: 857479 - protein, 221 aa, Homo sapiens [sequence omitted]

SEQ ID NO: 857480 - protein, 144 aa, Homo sapiens
FLSARILAPEYPVGGTPDPGPHAWGSSPNLPLGRQDAVEDRLDRNLWPFVSDPAPTASSQAAVSARFGHWHKNKAGVEARAGPRLIVYVMGGVAMSEMRAAYEVTRATEGKWEVLIGSSHILTPTRFLDDLKALDKKLEDIALP

SEQ ID NO: 857481 - protein, 89 aa, Homo sapiens; identical to SEQ ID NO: 857470

SEQ ID NO: 857482 - protein, 247 aa, Homo sapiens; identical to SEQ ID NO: 857454

SEQ ID NO: 857483 - protein, 500 aa, Homo sapiens
MPSGLRAPLPGPGVPDDARAADAGGGEEAGQVRDFNPEPRPSGVQNRSLGPGCVREEGSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857484 - protein, 453 aa, Homo sapiens
MALCLELLKQCSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857485 - protein, 453 aa, Homo sapiens; identical to SEQ ID NO: 857484

SEQ ID NO: 857486 - protein, 628 aa, Homo sapiens
MALCLELLKQCSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRVSRTEVAAASPLSSPSLRSHLSCSPYPTSPCWISNNQAGFGLRVVAQAWEAGQGRAGGQMSICSVRPVTHGGHGWARNMASAALMLVVFLAPLQYTGNLMTLSSCVCACGLGRDGARAEPRMRWGLWDPLQAHGEQMMHPSSLSPVCPGQGGLWSLALLVTHSFLSPPHPPPTHRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857487 - protein, 992 aa, Homo sapiens
MKGLGDSRPRHLSDSLDPPHEPLFAGTDRNPYLLSPTEAFAREARFPGQNTLPGDGLFPLNNQLPPPSSTFPRIHYNSHFEVPEESPFPSHAQATKINRLPANLLDQFEKQLPIHRDGFSTLQFPRGEAKARGESPGRIRHLVHSVQRLFFTKAPSLEGTAGKVGGNGSKKGGMEDGKGRRAKSKERAKAGEPKRRSRSNISGWWSSDDNLDGEAGAFRSSGPASGLMILGRQAERSQPRYFMHAYNTISGHMLKTTKNNTTELTAPPPPPAPPATCPSLGVGTDTNYVKRGSWSTLTLSHAHEVCQKTSATLDKSLLKSKSCHQGLAYHYLQVPGGGGEWSTTLLSPRETDAAAEGPIPCRRMRSGSYIKAMGDEDSDESGGSPKPSPKTAARRQSYLRATQQSLGEQSNPRRSLDRLDSVDMLLPSKCPSWEEDYTPVSDSLNDSSCISQIFGQASLIPQLFGHEQQVREAELSDQYEAACESACSEAESTAAETLDLPLPSYFRSRSHSYLRAIQAGCSQEEDSVSLQSLSPPPSTGSLSNSRTLPSSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857488 - protein, 451 aa, Homo sapiens
QWSSPCFTGSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857489 - protein, 285 aa, Homo sapiens
MSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857490 - protein, 323 aa, Homo sapiens
MRVKERTRRNGSHLSEDNGPKAIDVMAPSSESSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857491 - protein, 281 aa, Homo sapiens
LKFHVRGLGSVVHSLYLVVDYLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857492 - protein, 453 aa, Homo sapiens; identical to SEQ ID NO: 857484

SEQ ID NO: 857493 - protein, 245 aa, Homo sapiens
PPARPPARASVLSSRQSSSPCPRSARFVSPRLAVSLSLPSRSSAAPPSLPISGPLLRALFSPQSRPFWATPLFGTPPQSAPRSFGVPLENTFHSPQGLPVSFLHILWGFCTPSRWGLASSEPPLPLGFPSSGCSPYPLGAPRSQVGVFLLGTPQYVLSSLTSGAPLCFPLVCPLSLSLLVLSQVSEHPHFSGSGSPALLSLPLCAPTSVSVVSPLCATLMPTHAPQPRTWQGSGTCYSCPSRISA

SEQ ID NO: 857494 - protein, 245 aa, Homo sapiens; identical to SEQ ID NO: 857493

SEQ ID NO: 857495 - protein, 158 aa, Homo sapiens
PEPSSLGETAPGDMTCGSWKWDREAQPHSPGPREISGNRLGKSPPTGTPTPPSLTRTHTHADGGASLGGAPPALGSVRQDSLTAEQMREVLVLAGGNETKPQLSHSRLLPFYFLQPLLPSAKSRTPEWLPGGRQSSAAPVSGARGAGGGVCMYVYICT

SEQ ID NO: 857496 - protein, 186 aa, Homo sapiens
MALCLELLKQCSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRVSRTEVAAASPLSSPSLRSHLSCSP

SEQ ID NO: 857497 - protein, 196 aa, Homo sapiens
MALCLELLKQCSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRGKQGPSSKMFSGGTRLGSPEPRSREALRGSPEDLT

SEQ ID NO: 857498 - protein, 989 aa, Homo sapiens
MKGLGDSRPRHLSDSLDPPHEPLFAGTDRNPYLLSPTEAFAREARFPGQNTLPGDGLFPLNNQLPPPSSTFPRIHYNSHFEVPEESPFPSHAQATKINRLPANLLDQFEKQLPIHRDGFSTLQFPRGEAKARGESPGRIRHLVHSVQRLFFTKAPSLEGTAGKVGGNGSKKGGMEDGKGRRAKSKERAKAGEPKRRSRSNISGWWSSDDNLDGEAGAFRSSGPASGLMILGRQAERSQPRYFMHAYNTISGHMLKTTKNNTTELTAPPPPPAPPATCPSLGVGTDTNYVKRGSWSTLTLSHAHEVCQKTSATLDKSLLKSKSCHQGLAYHYLQVPGGGGEWSTTLLSPRETDAAAEGPIPCRRMRSGSYIKAMGDEDSDESGGSPKPSPKTAARRQSYLRATQQSLGEQSNPRRSLDRLDSVDMLLPSKCPSWEEDYTPVSDSLNDSSCISQIFGQASLIPQLFGHEQQVREAELSDQYEAACESACSEAESTAAETLDLPLPSYFRSRSHSYLRAIQAGCSQEEDSVSLQSLSPPPSTGSLSNSRTLPSSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQERTRRNGSHLSEDNGPKAIDVMAPSSESSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857499 - protein, 453 aa, Homo sapiens; identical to SEQ ID NO: 857484

SEQ ID NO: 857500 - protein, 453 aa, Homo sapiens; identical to SEQ ID NO: 857484

SEQ ID NO: 857501 - protein, 464 aa, Homo sapiens
MALCLELLKQCSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLGAREGGPFFGGEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857502 - protein, 285 aa, Homo sapiens; identical to SEQ ID NO: 857489

SEQ ID NO: 857503 - protein, 285 aa, Homo sapiens; identical to SEQ ID NO: 857489

SEQ ID NO: 857504 - protein, 285 aa, Homo sapiens; identical to SEQ ID NO: 857489

SEQ ID NO: 857505 - protein, 331 aa, Homo sapiens
QWSSPCFTGSSCLVAYKKTPPPVPPRTTSKPFISVTVQSSTESAQDTYLDSQDHKSEVTSQSGLSNSSDSLDSSTRPPSNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 857506 - protein, 156 aa, Homo sapiens
NGICPSPLLERSRSLGLLSAPVPSALPTVSHRFSWLPDSKCVLLVPDAGRLGWRLQLPAYGGGSATQNVAPLFYFCSLLTVSLKEEKKPPPPVPKKPAKSKPAVSRDKASDASDKQRQEARKRLLAAKRAASVRQNSATESADSIEIYVPEAQTRL

SEQ ID NO: 857507 - protein, 98 aa, Homo sapiens
FFFCTVAEKPLRSLVFSLFPSELTQWSPLWQAAFWVSALSAVEGPEDREMDMRPLPPPAKCSHTTSRAHTHTQMEAPHWEVPRQPWAVSGRTHSPLSR

SEQ ID NO: 857508 - protein, 365 aa, Homo sapiens
MALCLELLKQCSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLRTQSSVLWAVPSYWMSQKIPARSRASVDKIEPDANKRTRPGPGRGLGLHTRGPRLYGKVSSTPPP

SEQ ID NO: 857509 - protein, 190 aa, Homo sapiens
MALCLELLKQCSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQDGFSRGQKRRPAVNNPGTGPVEADWEAGSLFKDVLRRDQTRFPSAKIKGDTERKPGGPH

SEQ ID NO: 857510 - protein, 295 aa, Homo sapiens
MQPEGAEKGKSFKQRLVLKSSLAKETLSEFLGTFILIVLGCGCVAQAILSRGRFGGVITINVGFSMAVAMAIYVAGGVSGGHINPAVSLAMCLFGRMKWFKLPFYVGAQFLGAFVGAATVFGIYYDGLMSFAGGKLLIVGENATAHIFATYPAPYLSLANAFADQVVATMILLIIVFAIFDSRNLGAPRGLEPIAIGLLIIVIASSLGLNSGCAMNPARDLSPRLFTALAGWGFEVFRAGNNFWWIPVVGPLVGAVIGGLIYVLVIEIHHPEPDSVFKAEQSEDKPEKYELSVIM

SEQ ID NO: 857511 - protein, 216 aa, Homo sapiens
MQPEGAEKGKSFKQRLVLKSSLAKETLSEFLGTFILIVLGCGCVAQAILSRGRFGGVITINVGFSMAVAMAIYVAGGVSGGHINPAVSLAMCLFGRMKWFKLPFYVGAQFLGAFVGAATVFGIYYDGLMSFAGGKLLIVGENATAHIFATYPAPYLSLANAFADQKLGSPQRPRAHCHRPPDYCHCFLPGTEQWLCHEPSSRPESQTFHCLGRLGV

SEQ ID NO: 857512 - protein, 216 aa, Homo sapiens; identical to SEQ ID NO: 857511

SEQ ID NO: 857513 - protein, 216 aa, Homo sapiens; identical to SEQ ID NO: 857511

SEQ ID NO: 857514 - protein, 216 aa, Homo sapiens; identical to SEQ ID NO: 857511

SEQ ID NO: 857515 - protein, 159 aa, Homo sapiens
MQRRLVQQWSVAVFLLSYAVPSCGRSVEGLSRRLKRAVSEHQLLHDKGKSIQDLRRRFFLHHLIAEIHTAEIHPVRFGSDDEGRYLTQETNKVETYKEQPLKTPGKKKKGKPGKRKEQEKKKRRTRSAWLDSGVTGSGLEGDHLSDTSTTSLELDSRRH

SEQ ID NO: 857516 - protein, 175 aa, Homo sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSR

SEQ ID NO: 857517 - protein, 175 aa, Homo sapiens; identical to SEQ ID NO: 857516

SEQ ID NO: 857518 - protein, 177 aa, Homo sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRRH

SEQ ID NO: 857519 - protein, 177 aa, Homo sapiens; identical to SEQ ID NO: 857518

SEQ ID NO: 857520 - protein, 177 aa, Homo sapiens; identical to SEQ ID NO: 857518

SEQ ID NO: 857521 - protein, 175 aa, Homo sapiens; identical to SEQ ID NO: 857516

SEQ ID NO: 857522 - protein, 209 aa, Homo sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRTALLWGLKKKKENNRRTHHMQLMISLFKSPLLLL

SEQ ID NO: 857523 - protein, 374 aa, Homo sapiens
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 857524 - protein, 374 aa, Homo sapiens; identical to SEQ ID NO: 857523

SEQ ID NO: 857525 - protein, 368 aa, Homo sapiens [sequence omitted]

SEQ ID NO: 857526 - protein, 245 aa, Homo sapiens
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATESMKALEKLVKRRHPPVIFASLVQNVTKMPRMSGVCVILTVLKPTSIPSALLMGNLMIMHAKSKKHRVRNRRKLKSCLWVDVKITQLQLLSLKMGIMQEQIMQRMLTN

SEQ ID NO: 857527 - protein, 346 aa, Homo sapiens
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRAKL

SEQ ID NO: 857528 - protein, 374 aa, Homo sapiens; identical to SEQ ID NO: 857523

SEQ ID NO: 857529 - protein, 387 aa, Homo sapiens
SGKRQRDAGGRAREAAAGLRGALTLPPPCLLGLHSSAPGLPSPPVLRLPRLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 857530 - protein, 329 aa, Homo sapiens
NQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPH

SEQ ID NO: 857531 - protein, 326 aa, Homo sapiens
NQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKHGWRDFREQEWKIPGCGYYTLGVGRSLENCGSQTRWLLGFPPGVRRGLSSRVAGSIFGAPGSRCSRHPGITGGVRACLAVSA

SEQ ID NO: 857532 - protein, 303 aa, Homo sapiens
NQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRYKPRHIIVCECVCQCVYMHPHMCALM

SEQ ID NO: 857533 - protein, 1196 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKQSINKNKSQDFRLGSESMTHSEMRKEQSHEDQGHIMDTRMRKNKQAGRKVTLIE

SEQ ID NO: 857534 - protein, 1196 aa, Homo sapiens; identical to SEQ ID NO: 857533

SEQ ID NO: 857535 - protein, 1144 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKVK

SEQ ID NO: 857536 - protein, 1168 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKQSINKNKSQDFRLGSESMTHKELKKS

SEQ ID NO: 857537 - protein, 1079 aa, Homo sapiens
LLLLLNSRPRRPTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKVK

SEQ ID NO: 857538 - protein, 1144 aa, Homo sapiens; identical to SEQ ID NO: 857535

SEQ ID NO: 857539 - protein, 1053 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTDSHFAEFNTCILWWKKH

SEQ ID NO: 857540 - protein, 1144 aa, Homo sapiens; identical to SEQ ID NO: 857535

SEQ ID NO: 857541 - protein, 1023 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPNTGLSNDELTTEDLPDSSTNQAQRSEEPPVAKYKPNKPANKEEEVRRQGRGTDHPAKQQYRGHPPRA

SEQ ID NO: 857542 - protein, 1062 aa, Homo sapiens [sequence omitted]

SEQ ID NO: 857543 - protein, 1196 aa, Homo sapiens; identical to SEQ ID NO: 857533

SEQ ID NO: 857544 - protein, 1147 aa, Homo sapiens
MAVSFVAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKVK

SEQ ID NO: 857545 - protein, 1123 aa, Homo sapiens
QIDHSDTLFHDDKLSSEKRKKKKKFQSSLKLKQGIFALINVKYPLRKTLLFSGFEYYLWFNKENSYAFIKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKVK

SEQ ID NO: 857546 - protein, 581 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLVKN

SEQ ID NO: 857547 - protein, 996 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVIKCPAQIEQGFMENSLY

SEQ ID NO: 857548 - protein, 393 aa, Homo sapiens
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKSVLVK

SEQ ID NO: 857549 - protein, 393 aa, Homo sapiens; identical to SEQ ID NO: 857548

SEQ ID NO: 857550 - protein, 352 aa, Homo sapiens [sequence omitted]

SEQ ID NO: 857551 - protein, 321 aa, Homo sapiens
MAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKSVLVK

SEQ ID NO: 857552 - protein, 321 aa, Homo sapiens; identical to SEQ ID NO: 857551

SEQ ID NO: 857553 - protein, 396 aa, Homo sapiens
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKLLTKVKGS

SEQ ID NO: 857554 - protein, 200 aa, Homo sapiens
FFVPSSPPCSAFSFFPRLRCGVLFPPLVLFFRRSPPSGCSGCWCVLCDTAGSSARQLRCLLFAASSAASWPFLFVFVPPRALSVALVLLYMSRPLSLVCVPAPLSSHIHTTLGRALCARSMSFRPRPVAAVGRRVGLPPSSLFFFLFFVFLVVLSFFLFLFLSLSFVFFVLFSFFSFFFCFFFFFGQIKMLYLFSPRVAF

SEQ ID NO: 857555 - protein, 393 aa, Homo sapiens; identical to SEQ ID NO: 857548

SEQ ID NO: 857556 - protein, 242 aa, Homo sapiens
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQPSPRCSQSHSLCLCLRLRALRSPAASRAATTTAAVFPPWRPHHGALSAKVSAGEVRAGSNGGTQGRGTGVEGVGHLQDPSRHPPGPGSSGFGRWSFLPGH

SEQ ID NO: 857557 - protein, 218 aa, Homo sapiens
MKLCRDAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQPSPRCSQSHSLCLCLRLRALRSPAASRAATTTAAVFPPWRPHHGALSAKVSAGEVRAGSNGGTQGRGTGVEGVGHLQDPSRHPPGPGSSGFGRWSFLPGH

SEQ ID NO: 857558 - protein, 224 aa, Homo sapiens
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQPSPRCSQSHSLCLCLRLRALRSPAASRAATTTAAVFPPWRPHHGALSAKVAHQGEGFLAAGIEDIGLASFSLLALGPAGTKL

SEQ ID NO: 857559 - protein, 106 aa, Homo sapiens [sequence omitted]

SEQ ID NO: 857560 - protein, 161 aa, Homo sapiens
MKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVCLAAPRARGQAEGCG

SEQ ID NO: 857561 - protein, 1114 aa, Homo sapiens
DRARSLVIHRHPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857562 - protein, 1414 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857563 - protein, 687 aa, Homo sapiens
YRVYGKKNILVTECVSSTDVEATGCSTLNVGDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857564 - protein, 1442 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCLAGGGRMASKRQGARPESLLMPHPFHRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857565 - protein, 1441 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVIWVEGGPRWACGQGRVITQGSLSPCQVYIQHMRSKEHERPRRLRLVRKGNEQHAFTRCFHAWSAFCKALA

SEQ ID NO: 857566 - protein, 405 aa, Homo sapiens
DPRCSDPRFRADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857567 - protein, 1349 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEV

SEQ ID NO: 857568 - protein, 357 aa, Homo sapiens
MLGTIRRVCVEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857569 - protein, 1270 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKGGVVGVSQDSVDQGVGCLGAESAANTPTPAHSPGSL

SEQ ID NO: 857570 - protein, 348 aa, Homo sapiens
EELTARYEASGVESLICRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857571 - protein, 1334 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVRRRAGRRAHTEEPGQAGALGWTGLSRRLLSTKVRSLRTSSGWALGHRSPMMTMPST

SEQ ID NO: 857572 - protein, 1405 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMRVSPSSLTAPCASLPKLRARSKRTTIPDRGGPVFGQGYTSSCAPLLEPPNKLSR

SEQ ID NO: 857573 - protein, 1470 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVRRRAGRRAHTEEPGQAGALELDWPFPQVVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVIWVEGGPRWACGQGRVITQGSLSPCQVYIQHMRSKEHERPRRLRLVRKGNEQHAFTRCFHAWSAFCKALA

SEQ ID NO: 857574 - protein, 1248 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKPHSSARDKADVDAL

SEQ ID NO: 857575 - protein, 1165 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEWYA

SEQ ID NO: 857576 - protein, 943 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVSPAAEAHLERLLQGPGLRQAGTAPGLVRKRKGPHPLSASKECTQVTPPAPATSSATVPSSLKQHQWG

SEQ ID NO: 857577 - protein, 741 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVPAR

SEQ ID NO: 857578 - protein, 128 aa, Homo sapiens
MVFRMSSANLASSGSDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857579 - protein, 657 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAARELRPNGPIWHRNDCRHGEKAAKGTSKPQRMEPRAEGKGCPGKRGNGHSNWPSPTKRTANPANPQPTRKATRGTGQAKATGPQEIGPQQVTRHTPP

SEQ ID NO: 857580 - protein, 113 aa, Homo sapiens [sequence omitted]

SEQ ID NO: 857581 - protein, 1294 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857582 - protein, 1414 aa, Homo sapiens; identical to SEQ ID NO: 857562

SEQ ID NO: 857583 - protein, 1442 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPVRLRPSEGDGRKAVSLALTSHPCPFPLQSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857584 - protein, 1137 aa, Homo sapiens
GWYGPGVRHGTRLELCYSDFCDYDDALTLTLCLENSPEPPCEGVCPNGETWAHSSCHLPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857585 - protein, 1497 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKVRAGHAVRGHVAQYLPLRWLSPQLQSFVQGGQVGGGQAAGGGPGTGAVQSPWGWEACAVQSGVSGVAEKTRMKADVAVCLGFQTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857586 - protein, 1313 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFR

SEQ ID NO: 857587 - protein, 1334 aa, Homo sapiens; identical to SEQ ID NO: 857571

SEQ ID NO: 857588 - protein, 1433 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDQWVHVETLNLSRNQLTSLPVRLRPSVGGWEEGREPGPDLPPLPFPLQSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKVRAGHAVRGHVAQYLPLRWLSPQLQSFVQGGQVGGGQAAGGGPGTGAVQSPWGWEACAVQSGVSGVAWKTRMKADVAVCLGFQTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCLAGGGRSGEQAQGARPESLLMPHPFHRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857589 - protein, 1443 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVRRRAGRRAHTEEPGQAGALELDWPFPQVVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857590 - protein, 1349 aa, Homo sapiens; identical to SEQ ID NO: 857567

SEQ ID NO: 857591 - protein, 1313 aa, Homo sapiens; identical to SEQ ID NO: 857586

SEQ ID NO: 857592 - protein, 1407 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVRRRAGRRAHTEEPGQAGALGWTGLSRRLCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857593 - protein, 342 aa, Homo sapiens
MCCGDSKDPSEVRRTTWKIEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857594 - protein, 1248 aa, Homo sapiens; identical to SEQ ID NO: 857574

SEQ ID NO: 857595 - protein, 259 aa, Homo sapiens
SRGSFGSVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857596 - protein, 262 aa, Homo sapiens
LYFLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857597 - protein, 1178 aa, Homo sapiens
QPAAPPSALAPALPSPARPGSESGAMEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLAGQAAPGAPLSSGPLWALLLPWVEGVEPCSSDQYPEGQGWSYVTVTFAIMMMPNTDFMPRKLPRNPHVREFVQMEKLGRTAVVTVPKPHSSEVAELGFTLGLAALAPGVWAPADATPPCTPDVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVCLAAPRARGQAEGCG

SEQ ID NO: 857598 - protein, 138 aa, Homo sapiens
MVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 857599 - protein, 88 aa, Homo sapiens
IWTRNDAGQMTDLMYARQLAKKVYMWVGTQTSQVEIKLSLKACQVYIQHMRSKEHERPRRLRLVRKGNEQHAFTRCFHAWSAFCKALA

SEQ ID NO: 857600 - protein, 315 aa, Homo sapiens
PRVRTRQESLLCHPRCQLAHNVAVNFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVSPAAEAHLERLLQGPGLRQAGTAPGLVRKRKGPHPLSASKECTQVTPPAPATSSATVPSSLKQHQWG

SEQ ID NO: 857601 - protein, 213 aa, Homo sapiens
MEFMRQQIGQSCNSHIHSDAPGALTAPATGQVPDVVARATVVVLTFLLSSCDARIYSQGPWVTRVSLRVSLRLSAYLPRAWGLASKAHCTRISKTQVSVSPIAECLPQHCLWSQLLGSGPALGQVAAQQRSAHAAPTHARIGSCASDCCSLTAAWPEVGCQVSWVLSPGTLRPKCQSVDYGMFGASGRGLRQWLFWSPMVATAGRALLPVNEL

SEQ ID NO: 857602 - protein, 717 aa, Homo sapiens
MSGDGATEQAAEYVPEKVKKAEKKLEENPYDLDAWSILIREAQNQPIDKARKTYERLVAQFPSSGRFWKLYIEAEIKAKNYDKVEKLFQRCLMKVLHIDLWKCYLSYVRETKGKLPSYKEKMAQAYDFALDKIGMEIMSYQIWVDYINFLKGVEAVGSYAENQRITAVRRVYQRGCVNPMINIEQLWRDYNKYEEGINIHLAKKMIEDRSRDYMNARRVAKEYETVMKGLDRNAPSVPPQNTPQEAQQVDMWKKYIQWEKSNPLRTEDQTLITKRVMFAYEQCLLVLGHHPDIWYEAAQYLEQSSKLLAEKGDMNNAKLFSDEAANIYERAISTLLKKNMLLYFAYADYEESRMKYEKVHSIYNRLLAIEDIDPTLVYIQYMKFARRAEGIKSGRMIFKKAREDTRTRHHVYVTAALMEYYCSKDKSVAFKIFELGLKKYGDIPEYVLAYIDYLSHLNEDNNTRVLFERVLTSGSLPPEKSGEIWARFLAFESNIGDLASILKVEKRRFTAFKEEYEGKETALLVDRYKFMDLYPCSASELKALGYKDVSRAKLAAIIPDPVVAPSIVPVLKDEVDRKPEYPKPDTQQMIPFQPRHLAPPGLHPVPGGVFPVPPAAVVLMKLLPPPICFQGPFVQVDELMEIFRRCKIPNTVEEAVRIITGGAPELAVEGNGPVESNAVLTKAVKRPNEDSDEDEEKGAVVPPVHDIYRARQQKRIR

SEQ ID NO: 857603 - protein, 106 aa, Homo sapiens
RTRGELMETDRRREKFPSVGPFVQVDELMEIFRRCKIPNTVEEAVRIITGGAPELAVEGNGPVESNAVLTKAVKRPNEDSDEDEEKGAVVPPVHDIYRARQQKRIR

SEQ ID NO: 857604 - protein, 680 aa, Homo sapiens
MSGDGATEQAAEYVPEKVKKAEKKLEENPYDLDAWSILIREAQNQPIDKARKTYERLVAQFPSSGRFWKLYIEAEIKAKNYDKVEKLFQRCLMKVLHIDLWKCYLSYVRETKGKLPSYKEKMAQAYDFALDKIGMEIMSYQIWVDYINFLKGVEAVGSYAENQRITAVRRVYQRGCVNPMINIEQLWRDYNKYEEGINIHLAKKMIEDRSRDYMNARRVAKEYETVMKGLDRNAPSVPPQNTPQEAQQVDMWKKYIQWEKSNPLRTEDQTLITKRGYENAKLFSDEAANIYERAISTLLKKNMLLYFAYADYEESRMKYEKVHSIYNRLLAIEDIDPTLVYIQYMKFARRAEGIKSGRMIFKKAREDTRTRHHVYVTAALMEYYCSKDKSVAFKIFELGLKKYGDIPEYVLAYIDYLSHLNEDNNTRVLFERVLTSGSLPPEKSGEIWARFLAFESNIGDLASILKVEKRRFTAFKEEYEGKETALLVDRYKFMDLYPCSASELKALGYKDVSRAKLAAIIPDPVVAPSIVPVLKDEVDRKPEYPKPDTQQMIPFQPRHLAPPGLHPVPGGVFPVPPAAVVLMKLLPPPICFQGPFVQVDELMEIFRRCKIPNTVEEAVRIITGGAPELAVEGNGPVESNAVLTKAVKRPNEDSDEDEEKGAVVPPVHDIYRARQQKRIR

SEQ ID NO: 857605 - protein, 749 aa, Homo sapiens
MSGDGATEQVETRSHCVSQAGLELLDLSDPPASAFQTVGLQAAEYVPEKVKKAEKKLEENPYDLDAWSILIREAQNQPIDKARKTYERLVAQFPSSGRFWKLYIEAEIKAKNYDKVEKLFQRCLMKVLHIDLWKCYLSYVRETKGKLPSYKEKMAQAYDFALDKIGMEIMSYQIWVDYINFLKGVEAVGSYAENQRITAVRRVYQRGCVNPMINIEQLWRDYNKYEEGINIHLAKKMIEDRSRDYMNARRVAKEYETVMKGLDRNAPSVPPQNTPQEAQQVDMWKKYIQWEKSNPLRTEDQTLITKRVMFAYEQCLLVLGHHPDIWYEAAQYLEQSSKLLAEKGDMNNAKLFSDEAANIYERAISTLLKKNMLLYFAYADYEESRMKYEKVHSIYNRLLAIEDIDPTLVYIQYMKFARRAEGIKSGRMIFKKAREDTRTRHHVYVTAALMEYYCSKDKSVAFKIFELGLKKYGDIPEYVLAYIDYLSHLNEDNNTRVLFERVLTSGSLPPEKSGEIWARFLAFESNIGDLASILKVEKRRFTAFKEEYEGKETALLVDRYKFMDLYPCSASELKALGYKDVSRAKLAAIIPDPVVAPSIVPVLKDEVDRKPEYPKPDTQQMIPFQPRHLAPPGLHPVPGGVFPVPPAAVVLMKLLPPPICFQGPFVQVDELMEIFRRCKIPNTVEEAVRIITGGAPELAVEGNGPVESNAVLTKAVKRPNEDSDEDEEKGAVVPPVHDIYRARQQKRIR

SEQ ID NO: 857606 - protein, 717 aa, Homo sapiens; identical to SEQ ID NO: 857602

SEQ ID NO: 857607 - protein, 482 aa, Homo sapiens
MSGDGATEQAAEYVPEKVKKAEKKLEENPYDLDAWSILIREAQNQPIDKARKTYERLVAQFPSSGRFWKLYIEAEIKAKNYDKVEKLFQRCLMKVLHIDLWKCYLSYVRETKGKLPSYKEKMAQAYDFALDKIGMEIMSYQIWVDYINFLKGVEAVGSYAENQRITAVRRVYQRGCVNPMINIEQLWRDYNKYEEGINIHLAKKMIEDRSRDYMNARRVAKEYETVMKGLDRNAPSVPPQNTPQEAQQVDMWKKYIQWEKSNPLRTEDQTLITKRVMFAYEQCLLVLGHHPDIWYEAAQYLEQSSKLLAEKGDMNNAKLFSDEAANIYERAISTLLKKNMLLYFAYADYEESRMKYEKVHSIYNRLLAIEDIDPTLVYIQYMKFARRAEGIKSGRMIFKKAREDTRTRHHVYVTAALMEYYCSKDKSVAFKIFELGLKKYGDIPEYVLAYIDYLSHLNEDNNTRVLFERVLTSGSLPPEKSG

SEQ ID NO: 857608 - protein, 103 aa, Homo sapiens
MSGDGATEQAAEYVPEKVKKAEKKLEENPYDLDAWSILIREAQNQPIDKARKTYERLVAQFPSSGRFWKLYIEAEVTILFYFFLYQYCSIHCSDRKQVRNIAN

SEQ ID NO: 857609 - protein, 103 aa, Homo sapiens; identical to SEQ ID NO: 857608

SEQ ID NO: 857610 - protein, 625 aa, Homo sapiens
MKVLHIDLWKCYLSYVRETKGKLPSYKEKMAQAYDFALDKIGMEIMSYQIWVDYINFLKGVEAVGSYAENQRITAVRRVYQRGCVNPMINIEQLWRDYNKYEEGINIHLAKKMIEDRSRDYMNARRVAKEYETVMKGLDRNAPSVPPQNTPQEAQQVDMWKKYIQWEKSNPLRTEDQTLITKRVMFAYEQCLLVLGHHPDIWYEAAQYLEQSSKLLAEKGDMNNAKLFSDEAANIYERAISTLLKKNMLLYFAYADYEESRMKYEKVHSIYNRLLAIEDIDPTLVYIQYMKFARRAEGIKSGRMIFKKAREDTRTRHHVYVTAALMEYYCSKDKSVAFKIFELGLKKYGDIPEYVLAYIDYLSHLNEDNNTRVLFERVLTSGSLPPEKSGEIWARFLAFESNIGDLASILKVEKRRFTAFKEEYEGKETALLVDRYKFMDLYPCSASELKALGYKDVSRAKLAAIIPDPVVAPSIVPVLKDEVDRKPEYPKPDTQQMIPFQPRHLAPPGLHPVPGGVFPVPPAAVVLMKLLPPPICFQGPFVQVDELMEIFRRCKIPNTVEEAVRIITGGAPELAVEGNGPVESNAVLTKAVKRPNEDSDEDEEKGAVVPPVHDIYRARQQKRIR

SEQ ID NO: 857611 - protein, 282 aa, Homo sapiens
MHMKILLHRKSELKKIKIFFNILEDNNTRVLFERVLTSGSLPPEKSGEIWARFLAFESNIGDLASILKVEKRRFTAFKEEYEGKETALLVDRYKFMDLYPCSASELKALGYKDVSRAKLAAIIPDPVVAPSIVPVLKDEVDRKPEYPKPDTQQMIPFQPRHLAPPGLHPVPGGVFPVPPAAVVLMKLLPPPICFQGPFVQVDELMEIFRRCKIPNTVEEAVRIITGGAPELAVEGNGPVESNAVLTKAVKRPNEDSDEDEEKGAVVPPVHDIYRARQQKRIR

SEQ ID NO: 857612 - protein, 717 aa, Homo sapiens; identical to SEQ ID NO: 857602

SEQ ID NO: 857613 - protein, 104 aa, Homo sapiens
WGGKLVYWVWGTAPVMERGECRAPVSRAHIYSRGVGVVCAEGGARATRKVGYMRREAARWIGPIGGEQGASRFRFWQKGEVGGKRRRESRGGGEAGARDRGGAR

SEQ ID NO: 857614 - protein, 442 aa, Homo sapiens
PDWLFGAARGLAGASSRSRAESGTMAPRGRRRPRPHRSESARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKMISDIEKKRQRMIEVQDELLRLEPQLKQLQTKYDELKERKSSLRNAAYFLSNLKQLYQDYSDVQAQEPNVKETYDSSSLPALLFKARTLLGAESHLRNINHQLEKLLDQG

SEQ ID NO: 857615 - protein, 442 aa, Homo sapiens; identical to SEQ ID NO: 857614

SEQ ID NO: 857616 - protein, 442 aa, Homo sapiens; identical to SEQ ID NO: 857614

SEQ ID NO: 857617 - protein, 344 aa, Homo sapiens
PDWLFGAARGLAGASSRSRAESGTMAPRGRRRPRPHRSESARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKVRATAETTTNKI

SEQ ID NO: 857618 - protein, 438 aa, Homo sapiens
REGSRLAADGAQSHTPRRSEENRSSPGPGKAAWRRSARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKMISDIEKKRQRMIEVQDELLRLEPQLKQLQTKYDELKERKSSLRNAAYFLSNLKQLYQDYSDVQAQEPNVKETYDSSSLPALLFKARTLLGAESHLRNINHQLEKLLDQG

SEQ ID NO: 857619 - protein, 431 aa, Homo sapiens
PDWLFGAARGLAGASSRSRAESGTMAPRGRRRPRPHRSESARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSEGMKTSDIKELNIVLPEFEKTHLEHQQRIESKVCKAAIATFYVNVKEQFIKMLKESQMLTNLKRKNAKMISDIEKKRQRMIEVQDELLRLEPQLKQLQTKYDELKERKSSLRNAAYFLSNLKQLYQDYSDVQAQEPNVKETYDSSSLPALLFKARTLLGAESHLRNINHQLEKLLDQG

SEQ ID NO: 857620 - protein, 442 aa, Homo sapiens; identical to SEQ ID NO: 857614

SEQ ID NO: 857621 - protein, 442 aa, Homo sapiens; identical to SEQ ID NO: 857614

SEQ ID NO: 857622 - protein, 338 aa, Homo sapiens
PDWLFGAARGLAGASSRSRAESGTMAPRGRRRPRPHRSESARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKMKKLSH

SEQ ID NO: 857623 - protein, 91 aa, Homo sapiens
PDWLFGAARGLAGASSRSRAESGTMAPRGRRRPRPHRSESARRSKNTLERTHSMKDKAGQKCKPIDVFDFPDNSDVSSIGRLGENEKDEAP

SEQ ID NO: 857624 - protein, 230 aa, Homo sapiens
PDWLFGAARGLAGASSRSRAESGTMAPRGRRRPRPHRSESARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPFWGFFWGKQNKFI

SEQ ID NO: 857625 - protein, 442 aa, Homo sapiens; identical to SEQ ID NO: 857614

SEQ ID NO: 857626 - protein, 442 aa, Homo sapiens; identical to SEQ ID NO: 857614

SEQ ID NO: 857627 - protein, 338 aa, Homo sapiens; identical to SEQ ID NO: 857622

SEQ ID NO: 857628 - protein, 243 aa, Homo sapiens
PDWLFGAARGLAGASSRSRAESGTMAPRGRRRPRPHRSESARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSILLTLCTFGVQKE

SEQ ID NO: 857629 - protein, 298 aa, Homo sapiens
AVFSFTQPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKMISDIEKKRQRMIEVQDELLRLEPQLKQLQTKYDELKERKSSLRNAAYFLSNLKQLYQDYSDVQAQEPNVKETYDSSSLPALLFKARTLLGAESHLRNINHQLEKLLDQG

SEQ ID NO: 857630 - protein, 338 aa, Homo sapiens; identical to SEQ ID NO: 857622

SEQ ID NO: 857631 - protein, 310 aa, Homo sapiens
MAPRGRRRPRPHRSESARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKRSQSAAAPKKNPPATR

SEQ ID NO: 857632 - protein, 199 aa, Homo sapiens
MAPRGRRRPRPHRSESARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKATLAASVKGLHESSN

SEQ ID NO: 857633 - protein, 1047 aa, Homo sapiens
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNDISTPLPDNEMSYNTVYGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 857634 - protein, 121 aa, Homo sapiens
MHRKENLCAVEGPQATGCRDVHWAHADRSFKKWYLKKIRSTFLRKASLLPSHWFSETQLKAKFPALRACHGIPVSLDIVNISTFGVLFHRHGFNVQNQKVEKWCQITLERIIFLVISPFLK

SEQ ID NO: 857635 - protein, 1030 aa, Homo sapiens
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 857636 - protein, 1030 aa, Homo sapiens; identical to SEQ ID NO: 857635

SEQ ID NO: 857637 - protein, 827 aa, Homo sapiens
MDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 857638 - protein, 1030 aa, Homo sapiens; identical to SEQ ID NO: 857635

SEQ ID NO: 857639 - protein, 715 aa, Homo sapiens
MTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 857640 - protein, 1030 aa, Homo sapiens; identical to SEQ ID NO: 857635

SEQ ID NO: 857641 - protein, 864 aa, Homo sapiens
MDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLFGRGDNPPPAPQRVDSIQVHSSQPSGQAVTVSRQPSLNAYNSLTRSGLKRTPSLKPDVPPKPSFAPLSTSMKPNDACT

SEQ ID NO: 857642 - protein, 457 aa, Homo sapiens
MKTGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 857643 - protein, 403 aa, Homo sapiens [sequence omitted]

SEQ ID NO: 857644 - protein, 1030 aa, Homo sapiens; identical to SEQ ID NO: 857635

SEQ ID NO: 857645 - protein, 882 aa, Homo sapiens
MDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 857646 - protein, 769 aa, Homo sapiens
MGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 857647 - protein, 710 aa, Homo sapiens
MGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 857648 - protein, 864 aa, Homo sapiens
MDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 857649 - protein, 917 aa, Homo sapiens
MDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTHTHAHNTYTHTHRGEQKLKHFVHNFTGRGQTGFAFQPAKHKYIF

SEQ ID NO: 857650 - protein, 846 aa, Homo sapiens
MDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSLQQVGPTKDFSYHHKHEPKAHTYPIPHPPHTHTHAHNTYTHTHRGEQKLKHFVHNFTGRGQTGFAFQPAKHKYIF

SEQ ID NO: 857651 - protein, 116 aa, Homo sapiens [sequence omitted]

SEQ ID NO: 857652 - protein, 237 aa, Homo sapiens
SVSSDLGAKLNFEFKRCHERGKELPLSSLQGPERGSSFCFQNADLYIMLVSLLLIGVAAWGKGLGLVSSIHIIGGVIAVGVFLLLIAVAGLVGAVNHHQVLLFFYMIILGLVFIFQFVISCSCLAINRSKQTDVINASWWVMSNKTRDELERSFDCCGLFNLTTLYQQDYDFCTAICKSQSPTCQMCGEKFLKHSDEALKILGGVGLFFSFTEILGVWLAMRFRNQKDPRANPSAFL

SEQ ID NO: 857653 - protein, 210 aa, Homo sapiens
MVCGGFACSKNALCALNVVYMLVSLLLIGVAAWGKGLGLVSSIHIIGGVIAVGVFLLLIAVAGLVGAVNHHQVLLFFYMIILGLVFIFQFVISCSCLAINRSKQTDVINASWWVMSNKTRDELERSFDCCGLFNLTTLYQQDYDFCTAICKSQSPTCQMCGEKFLKHSDEALKILGGVGLFFSFTEILGVWLAMRFRNQKDPRANPSAFL

SEQ ID NO: 857654 - protein, 632 aa, Homo sapiens
MKALLLLVLPWLSPANYIDNVGNLHFLYSELCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 857655 - protein, 728 aa, Homo sapiens
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLNKLLVTCPFREHCTQVLQRCDLEHHFQTSCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 857656 - protein, 156 aa, Homo sapiens
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLNKLLVTCPFREHCTQVLQRCDLEHHFQTSQAWRHAPVVPATWEAEAGGLLEPRSSPLQ

SEQ ID NO: 857657 - protein, 632 aa, Homo sapiens; identical to SEQ ID NO: 857654

SEQ ID NO: 857658 - protein, 530 aa, Homo sapiens
IGLPVSLHLSTTLQKEQSTLPTGLLVAELQVLTQIRLFEKQRARKTQAQRPCHFCGLRSLLAQAPASLGKATMNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 857659 - protein, 237 aa, Homo sapiens
IGLPVSLHLSTTLQKEQSTLPTGLLVAELQVLTQIRLFEKQRARKTQAQRPCHFCGLRSLLAQAPASLGKATMNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGSACGPDECSRSQASGLLFASSTICHCFSWVRPRLHWLSVAL

SEQ ID NO: 857660 - protein, 530 aa, Homo sapiens; identical to SEQ ID NO: 857658

SEQ ID NO: 857661 - protein, 76 aa, Homo sapiens
GVGRDITGGGGGAEEKEGSTEVVRWDYVRPRCCVWSYGLSEDIGREEVARDQRRPRIALESVRTKEMELARGLEGA

SEQ ID NO: 857662 - protein, 530 aa, Homo sapiens; identical to SEQ ID NO: 857658

SEQ ID NO: 857663 - protein, 76 aa, Homo sapiens
PGKALLESHWSCAALERPLEVLERKGVAVGTDLLPFFFVPAAGFRRHVAPFEARGQADPTCSLPRCLPRVSCLRTR

SEQ ID NO: 857664 - protein, 385 aa, Homo sapiens
MKMLPGVGVFGTGSSARVLVPLLRAEGFTVEALWGKTEEEAKQLAEEMNIAFYTSRTDDILLHQDVDLVCISIPPPLTRQISVKALGIGKNVVCEKAATSVDAFRMVTASRYYPQLMSLVGNVLRFLPAFVRMKQLISEHYVGAVMICDARIYSGSLLSPSYGWICDELMGGGGLHTMGTYIVDLLTHLTGRRAEKVHGLLKTFVRQNAAIRGIRHVTSDDFCFFQMLMGGGVCSTVTLNFNMPGAFVHEVMVVGSAGRLVARGADLYGQKNSATQEELLLRDSLAVGAGLPEQGPQDVPLLYLKGMVYMVQALRQSFQGQGDRRTWDRTPVSMAASFEDGLYMQSVVDAIKRSSRSGEWEAVEVLTEEPDTNQNLCEALQRNNL

SEQ ID NO: 857665 - protein, 385 aa, Homo sapiens; identical to SEQ ID NO: 857664

SEQ ID NO: 857666 - protein, 253 aa, Homo sapiens [sequence omitted]

SEQ ID NO: 857667 - protein, 104 aa, Homo sapiens
SSRLRPLPAQAHPRYGACAVLLPSRPSLSRAPSSLETRRRVPGGGALDSRARASPPAFLKADGWPPRPRRTHGFQCSAEWAMPACQEPCLTRTFGRSYPCQRLL

SEQ ID NO: 857668 - protein, 112 aa, Homo sapiens
MKMLPGVGVFGTGSSARVLVPLLRAEGFTVEALWGKTEEEAKQLAEEMNIAFYTSRTDDILLHQDVDLVCISIPPPLTRQISVKALGTPGRPQQGQIMSLPLGSPLRVTPLL

SEQ ID NO: 857669 - protein, 104 aa, Homo sapiens; identical to SEQ ID NO: 857667

SEQ ID NO: 857670 - protein, 280 aa, Homo sapiens
MVTASRYYPQLMSLVGNVLRFLPAFVRMKQLISEHYVGAVMICDARIYSGSLLSPSYGWICDELMGGGGLHTMGTYIVDLLTHLTGRRAEKVHGLLKTFVRQNAAIRGIRHVTSDDFCFFQMLMGGGVCSTVTLNFNMPGAFVHEVMVVGSAGRLVARGADLYGQKNSATQEELLLRDSLAVGAGLPEQGPQDVPLLYLKGMVYMVQALRQSFQGQGDRRTWDRTPVSMAASFEDGLYMQSVVDAIKRSSRSGEWEAVEVLTEEPDTNQNLCEALQRNNL

SEQ ID NO: 857671 - protein, 280 aa, Homo sapiens; identical to SEQ ID NO: 857670

SEQ ID NO: 857672 - protein, 112 aa, Homo sapiens; identical to SEQ ID NO: 857668

SEQ ID NO: 857673 - protein, 165 aa, Homo sapiens
MKMLPGVGVFGTGSSARVLVPLLRAEGFTVEALWGKTEEEAKQLAEEMNIAFYTSRTDDILLHQDVDLVCISIPPPLTRQISVKALGIGKNVVCEKAATSVDAFRMVTASRYYPQLMSLVGNVLRFLPAFVRMKQLISEHYVGAVMICDASESDQERLTLGSPSA

SEQ ID NO: 857674 - protein, 173 aa, Homo sapiens
MAAMASLGALALLLLSSLSRCSAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 857675 - protein, 135 aa, Homo sapiens
LLLNSAALDCGDLPDMQEQGNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQACDVY

SEQ ID NO: 857676 - protein, 173 aa, Homo sapiens; identical to SEQ ID NO: 857674

SEQ ID NO: 857677 - protein, 186 aa, Homo sapiens
MGPQLIRAMRQGRAILPSDRDTRAGLPRHLSLFPAAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 857678 - protein, 110 aa, Homo sapiens
MALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 857679 - protein, 110 aa, Homo sapiens; identical to SEQ ID NO: 857678

SEQ ID NO: 857680 - protein, 173 aa, Homo sapiens; identical to SEQ ID NO: 857674

SEQ ID NO: 857681 - protein, 173 aa, Homo sapiens; identical to SEQ ID NO: 857674

SEQ ID NO: 857682 - protein, 173 aa, Homo sapiens; identical to SEQ ID NO: 857674

SEQ ID NO: 857683 - protein, 173 aa, Homo sapiens; identical to SEQ ID NO: 857674

SEQ ID NO: 857684 - protein, 154 aa, Homo sapiens
MAAMASLGALALLLLSSLSRCSAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRVSGLVPPPFWGCWAE

SEQ ID NO: 857685 - protein, 128 aa, Homo sapiens
GRLLLLLLEFKLLTMYGNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 857686 - protein, 66 aa, Homo sapiens
PLTRRSSSFAPRVHGSSFSFPLGQRRGDGGDGISRRPGAAPAVQPLPLLSRGLPGAPDHPFLLHHF

SEQ ID NO: 857687 - protein, 161 aa, Homo sapiens
MGPQLIRAMRQGRAILPSDRDTRAGLPRHLSLFPAAEACLEPQITPSYYTTSDAVISTETVFIVEISLTCKNRVQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 857688 - protein, 328 aa, Homo sapiens
MPAQPFAEKRRWRRWHLSAPWRCSCCPASPAAQVAAQPGLLSCEPLTHGRWCWGQEGCGGPAFQGPSLRAGPSPERQAALGRGDQSTSRTFTGSQAFPCLPIRRGVPEPPWCARPPSCSTERDTCPGSRSLRGRTGAKLCSAERSRPKTGLEEPHKLGRDLSEEREQERGELDGEPEAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 857689 - protein, 148 aa, Homo sapiens
MAAMASLGALALLLLSSLSRCSAEACLEPQITPSYYTTSDAVISTETVFIVEISLTCKNRVQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 857690 - protein, 217 aa, Homo sapiens
MPAQPFAEKRRWRRWHLSAPWRCSCCPASPAAQVAAQPGLLSCEPLTHGRWCWGQEGCGGPAFQGPSLRAGPSPERQAALGRGDQSTSRTFTGSQAFPCLPIRRGVPEPPWCARPPSCSTERDTCPGSRSLRGRTGAKLCSAERSRPKTGLEEPHKLGRDLSEEREQERGELDGEPKVRRALSARPKTGFSGGPCLTLTRVFGRADQGSRRFAFVRG

SEQ ID NO: 857691 - protein, 173 aa, Homo sapiens; identical to SEQ ID NO: 857674

SEQ ID NO: 857692 - protein, 120 aa, Homo sapiens
PWALAAGVLQCRHWWSGWPLRVHSAHTLLNTQPRVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 857693 - protein, 173 aa, Homo sapiens; identical to SEQ ID NO: 857674

SEQ ID NO: 857694 - protein, 186 aa, Homo sapiens; identical to SEQ ID NO: 857677

SEQ ID NO: 857695 - protein, 186 aa, Homo sapiens; identical to SEQ ID NO: 857677

SEQ ID NO: 857696 - protein, 186 aa, Homo sapiens; identical to SEQ ID NO: 857677

SEQ ID NO: 857697 - protein, 110 aa, Homo sapiens; identical to SEQ ID NO: 857678

SEQ ID NO: 857698 - protein, 110 aa, Homo sapiens; identical to SEQ ID NO: 857678

SEQ ID NO: 857699 - protein, 173 aa, Homo sapiens; identical to SEQ ID NO: 857674

SEQ ID NO: 857700 - protein, 75 aa, Homo sapiens
RDTRAGLPRHLSLFPAAEACLEPQITPSYYTTSDAVISTETVFIVEISLTCKNRVQVRQWGFRQEGGWGVLLTAS

SEQ ID NO: 857701 - protein, 232 aa, Homo sapiens
GNGRAISAHVCRCGSRLVKSPMGSSFIRRWANRAMIGSGLAGSGGAGGPSSTVTWCALFSNHVAATQASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 857702 - protein, 232 aa, Homo sapiens; identical to SEQ ID NO: 857701

SEQ ID NO: 857703 - protein, 156 aa, Homo sapiens
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 857704 - protein, 156 aa, Homo sapiens; identical to SEQ ID NO: 857703

SEQ ID NO: 857705 - protein, 156 aa, Homo sapiens; identical to SEQ ID NO: 857703

SEQ ID NO: 857706 - protein, 156 aa, Homo sapiens; identical to SEQ ID NO: 857703

SEQ ID NO: 857707 - protein, 156 aa, Homo sapiens; identical to SEQ ID NO: 857703

SEQ ID NO: 857708 - protein, 156 aa, Homo sapiens; identical to SEQ ID NO: 857703

SEQ ID NO: 857709 - protein, 156 aa, Homo sapiens; identical to SEQ ID NO: 857703

SEQ ID NO: 857710 - protein, 149 aa, Homo sapiens
MSGGRAPAVLLGGVASLLLSFVWMPALLPVASRLLLSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 857711 - protein, 106 aa, Homo sapiens
MGYSRMGLSLHSRAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 857712 - protein, 102 aa, Homo sapiens [sequence omitted]

SEQ ID NO: 857713 - protein, 87 aa, Homo sapiens
GNGRAISAHVCRCGSRLVKSPMGSSFIRRWANRAMIGSGLAGSGGAGGPSSTVTWCALFSNHVAATQYPGKKRPLFLGLFLRVTCGL

SEQ ID NO: 857714 - protein, 132 aa, Homo sapiens
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMFCAPLRSGRGNCIACGTGELSVPAVGAPGHRVSF

SEQ ID NO: 857715 - protein, 132 aa, Homo sapiens; identical to SEQ ID NO: 857714

SEQ ID NO: 857716 - protein, 135 aa, Homo sapiens
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAESCHDEPCSCSS

SEQ ID NO: 857717 - protein, 126 aa, Homo sapiens
MPALLPVASRLLLSVSAAFVTCPNEKVAKEIARAVVEKRLAACVNLIPQITSIYEWKGKIEEDSEVLMMIKTQSSLVPALTDFVRLCTLTKGPRVMQWLLNQGTFRNFHWLRKVQKQVFDSIQFWQ

SEQ ID NO: 857718 - protein, 227 aa, Homo sapiens
IVKMVRLYYCTVLRAWCSNHLSCRPRLSESLSSVTCECSDVLAAHGEHSLAHVCVALPSEVCHLTTLVRTERSTARIPTTHCFRGGGYTLCSCTTIARVSQMSCNDLWNNLYPSMKVSGSGDQPWTAMNIPAHTLCMQFKPTITLMDTVTIYGVERYGNNLRKDSEVLMMIKTQSSLVPALTDFVRSVHPYEVAEVIALPVEQGNFPYLQWVRQVTESVSDSITVLP

SEQ ID NO: 857719 - protein, 156 aa, Homo sapiens; identical to SEQ ID NO: 857703

SEQ ID NO: 857720 - protein, 156 aa, Homo sapiens; identical to SEQ ID NO: 857703

SEQ ID NO: 857721 - protein, 156 aa, Homo sapiens; identical to SEQ ID NO: 857703

SEQ ID NO: 857722 - protein, 156 aa, Homo sapiens; identical to SEQ ID NO: 857703

SEQ ID NO: 857723 - protein, 156 aa, Homo sapiens; identical to SEQ ID NO: 857703

SEQ ID NO: 857724 - protein, 156 aa, Homo sapiens; identical to SEQ ID NO: 857703

SEQ ID NO: 857725 - protein, 156 aa, Homo sapiens; identical to SEQ ID NO: 857703

SEQ ID NO: 857726 - protein, 194 aa, Homo sapiens
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITGGHDLARSAHHKIREKKPLITVGPPVWPTTHPTHNLIHATP

SEQ ID NO: 857727 - protein, 115 aa, Homo sapiens
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVR

SEQ ID NO: 857728 - protein, 102 aa, Homo sapiens [sequence omitted]

SEQ ID NO: 857729 - protein, 87 aa, Homo sapiens; identical to SEQ ID NO: 857713

SEQ ID NO: 857730 - protein, 208 aa, Homo sapiens
GNGRAISAHVCRCGSRLVKSPMGSSFIRRWANRAMIGSGLAGSGGAGGPSSTVTWCALFSNHVAATQASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMFCAPLRSGRGNCIACGTGELSVPAVGAPGHRVSF

SEQ ID NO: 857731 - protein, 501 aa, Homo sapiens
SSRAPLLGECRSGRGLASSRSRRRTTMTQSVVVQVGQCGNQIGCCFWDLALREHAAVNQKGIYDEAISSFFRNVDTRVVGDGGSISKGKICSLKARAVLIDMEEGVVNEILQGPLRDVFDTKQLITDISGSGNNWAVGHKVFGSLYQDQILEKFRKSAEHCDCLQCFFIIHSMGGGTGSGLGTFLLKVLEDEFPEVYRFVTSIYPSGEDDVITSPYNSILAMKELNEHADCVLPIDNQSLFDIISKIDLMVNSGKLGTTVKPKSLVTSSSGALKKQHKKPFDAMNNIVANLLLNLTSSARFEGSLNMDLNEISMNLVPFPQLHYLVSSLTPLYTLTDVNIPPRRLDQMFSDAFSKDHQLLRADPKHSLYLACALMVRGNVQISDLRRNIERLKPSLQFVSWNQEGWKTSLCSVPPVGHSHSLLALANNTCVKPTFMELKERFMRLYKKKAHLHHYLQVEGMEESCFTEAVSSLSALIQEYDQLDATKNMPVQDLPRLSIAM

SEQ ID NO: 857732 - protein, 545 aa, Homo sapiens
MTQSVVVQVGQCGNQIGCCFWDLALREHAAVNQKGIYDEAISSFFRNVDTRVVGDGGSISKGKICSLKARAVLIDMEEGVVNEILQGPLRDVFDTKQLITDISGSGNNWAVGHKVFGSLYQDQILEKFRKSAEHCDCLQCFFIIHSMGGGTGSGLGTFLLKVLEDEFPEVYRFVTSIYPSGEDDVITSPYNSILAMKELNEHADCVLPIDNQVRNDIGTYEYNVIYIQSCIMYVCLYETFSSLFSLLREKISLNCFSFSFLVEYHLHPLFLIASLPMFFPQKSLFDIISKIDLMVNSGKLGTTVKPKSLVTSSSGALKKQHKKPFDAMNNIVANLLLNLTSSARFEGSLNMDLNEISMNLVPFPQLHYLVSSLTPLYTLTDVNIPPRRLDQMFSDAFSKDHQLLRADPKHSLYLACALMVRGNVQISDLRRNIERLKPSLQFVSWNQEGWKTSLCSVPPVGHSHSLLALANNTCVKPTFMELKERFMRLYKKKAHLHHYLQVEGMEESCFTEAVSSLSALIQEYDQLDATKNMPVQDLPRLSIAM

SEQ ID NO: 857733 - protein, 400 aa, Homo sapiens
MEEGVVNEILQGPLRDVFDTKQLITDISGSGNNWAVGHKVFGSLYQDQILEKFRKSAEHCDCLQCFFIIHSMGGGTGSGLGTFLLKVLEDEFPEVYRFVTSIYPSGEDDVITSPYNSILAMKELNEHADCVLPIDNQSLFDIISKIDLMVNSGKLGTTVKPKSLVTSSSGALKKQHKKPFDAMNNIVANLLLNLTSSARFEGSLNMDLNEISMNLVPFPQLHYLVSSLTPLYTLTDVNIPPRRLDQMFSDAFSKDHQLLRADPKHSLYLACALMVRGNVQISDLRRNIERLKPSLQFVSWNQEGWKTSLCSVPPVGHSHSLLALANNTCVKPTFMELKERFMRLYKKKAHLHHYLQVEGMEESCFTEAVSSLSALIQEYDQLDATKNMPVQDLPRLSIAM

SEQ ID NO: 857734 - protein, 484 aa, Homo sapiens
MASWSGAHTLTQSVVVQVGQCGNQIGCCFWDLALREHAAVNQKGIYDEAISSFFRNVDTRVVGDGGSISKGKICSLKARAVLIDMEEGVVNEILQGPLRDVFDTKQLITDISGSGNNWAVGHKVFGSLYQDQILEKFRKSAEHCDCLQCFFIIHSMGGGTGSGLGTFLLKVLEDEFPEVYRFVTSIYPSGEDDVITSPYNSILAMKELNEHADCVLPIDNQSLFDIISKIDLMVNSGKLGTTVKPKSLVTSSSGALKKQHKKPFDAMNNIVANLLLNLTSSARFEGSLNMDLNEISMNLVPFPQLHYLVSSLTPLYTLTDVNIPPRRLDQMFSDAFSKDHQLLRADPKHSLYLACALMVRGNVQISDLRRNIERLKPSLQFVSWNQEGWKTSLCSVPPVGHSHSLLALANNTCVKPTFMELKERFMRLYKKKAHLHHYLQVEGMEESCFTEAVSSLSALIQEYDQLDATKNMPVQDLPRLSIAM

SEQ ID NO: 857735 - protein, 106 aa, Homo sapiens
SSRAPLLGECRSGRGLASSRSRRRTTMTQSVVVQGKLRRAGRDLVAAESSGHVSCLMSYSLSFLSSGRSRPVRKPDRLLLLGPGTKGARRGQPGTRPPPRAPSPVS

SEQ ID NO: 857736 - protein, 189 aa, Homo sapiens
SSRAPLLGECRSGRGLASSRSRRRTTMTQSVVVQVGQCGNQIGCCFWDLALREHAAVNQKGIYDEAISSFFRNVDTRVVGDGGSISKGKICSLKARAVLIDMEEGVVNEILQGPLRDVFDTKQLITDISGSGNNWAVGHKVFGSLYQDQILEKFRKSAEHCDCLQCFFIIHSMGGGKIFHSFACNSVKG

SEQ ID NO: 857737 - protein, 79 aa, Homo sapiens
SSRAPLLGECRSGRGLASSRSRRRTTMTQSVVVQVGQCGNQIGCCFWDLALREHAAVNQKGIYDEAISSFFRNVDTRQS

SEQ ID NO: 857738 - protein, 501 aa, Homo sapiens; identical to SEQ ID NO: 857731

SEQ ID NO: 857739 - protein, 501 aa, Homo sapiens; identical to SEQ ID NO: 857731

SEQ ID NO: 857740 - protein, 106 aa, Homo sapiens; identical to SEQ ID NO: 857735

SEQ ID NO: 857741 - protein, 435 aa, Homo sapiens
CLVTMESDQRKVVGDGGSISKGKICSLKARAVLIDMEEGVVNEILQGPLRDVFDTKQLITDISGSGNNWAVGHKVFGSLYQDQILEKFRKSAEHCDCLQCFFIIHSMGGGTGSGLGTFLLKVLEDEFPEVYRFVTSIYPSGEDDVITSPYNSILAMKELNEHADCVLPIDNQSLFDIISKIDLMVNSGKLGTTVKPKSLVTSSSGALKKQHKKPFDAMNNIVANLLLNLTSSARFEGSLNMDLNEISMNLVPFPQLHYLVSSLTPLYTLTDVNIPPRRLDQMFSDAFSKDHQLLRADPKHSLYLACALMVRGNVQISDLRRNIERLKPSLQFVSWNQEGWKTSLCSVPPVGHSHSLLALANNTCVKPTFMELKERFMRLYKKKAHLHHYLQVEGMEESCFTEAVSSLSALIQEYDQLDATKNMPVQDLPRLSIAM

SEQ ID NO: 857742 - protein, 106 aa, Homo sapiens; identical to SEQ ID NO: 857735

SEQ ID NO: 857743 - protein, 118 aa, Homo sapiens
MKTFVNVYLWLLWIKQLKLHRLITIMSIITIMGHQHLGSSELSENQQPGAPNAPTHPAPPGLHHHHKHKGQHRQGHPENRDMPASEDLQDLQKKLCRKRCINQLLCKLPTDSELAPRS

SEQ ID NO: 857744 - protein, 129 aa, Homo sapiens
YVYKEQDIEINNKEVYCDVTTMLLSVSVNLTTLSASATCNMCSGLDAVAHACNPSTLGGQGRRITRTTPAMWRSLGLALALCLLPSGGTESQDQSSLCKQPPAWSIRDQDPMLNSIRRPASKTEERRIF

SEQ ID NO: 857745 - protein, 128 aa, Homo sapiens
YVYKEQDIEINNKEVYCDVTTMLLSVSVNLTTLSASATCNMCSGLDAVAHACNPSTLGGQGRRITRTTPAMWRSLGLALALCLLPSGGTESQDQSSLCKQPPAWSIRDQDPMLNSNGSVTVVALLQAS

SEQ ID NO: 857746 - protein, 128 aa, Homo sapiens; identical to SEQ ID NO: 857745

SEQ ID NO: 857747 - protein, 128 aa, Homo sapiens; identical to SEQ ID NO: 857745

SEQ ID NO: 857748 - protein, 128 aa, Homo sapiens; identical to SEQ ID NO: 857745

SEQ ID NO: 857749 - protein, 128 aa, Homo sapiens; identical to SEQ ID NO: 857745

SEQ ID NO: 857750 - protein, 128 aa, Homo sapiens; identical to SEQ ID NO: 857745

SEQ ID NO: 857751 - protein, 128 aa, Homo sapiens; identical to SEQ ID NO: 857745

SEQ ID NO: 857752 - protein, 128 aa, Homo sapiens; identical to SEQ ID NO: 857745

SEQ ID NO: 857753 - protein, 128 aa, Homo sapiens; identical to SEQ ID NO: 857745

SEQ ID NO: 857754 - protein, 128 aa, Homo sapiens; identical to SEQ ID NO: 857745

SEQ ID NO: 857755 - protein, 128 aa, Homo sapiens; identical to SEQ ID NO: 857745

SEQ ID NO: 857756 - protein, 128 aa, Homo sapiens; identical to SEQ ID NO: 857745

SEQ ID NO: 857757 - protein, 128 aa, Homo sapiens; identical to SEQ ID NO: 857745

SEQ ID NO: 857758 - protein, 128 aa, Homo sapiens; identical to SEQ ID NO: 857745

SEQ ID NO: 857759 - protein, 128 aa, Homo sapiens; identical to SEQ ID NO: 857745

SEQ ID NO: 857760 - protein, 128 aa, Homo sapiens; identical to SEQ ID NO: 857745

SEQ ID NO: 857761 - protein, 128 aa, Homo sapiens; identical to SEQ ID NO: 857745

SEQ ID NO: 857762 - protein, 128 aa, Homo sapiens; identical to SEQ ID NO: 857745

SEQ ID NO: 857763 - protein, 128 aa, Homo sapiens; identical to SEQ ID NO: 857745

SEQ ID NO: 857764 - protein, 128 aa, Homo sapiens; identical to SEQ ID NO: 857745

SEQ ID NO: 857765 - protein, 128 aa, Homo sapiens; identical to SEQ ID NO: 857745

SEQ ID NO: 857766 - protein, 521 aa, Homo sapiens
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDLWIDNMSSAVPNHSPEKKDSDFFTEHTQPPAWDAPATEPSGTQQPAPSTESSGLAQPEHGPNTDLLGTSPKASLELKSSIIGKKKPAAAKKGLGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 857767 - protein, 521 aa, Homo sapiens; identical to SEQ ID NO: 857766

SEQ ID NO: 857768 - protein, 512 aa, Homo sapiens
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDLWIDNMSSAVPNHSPEKKDSDFFTEHTQPPAWDAPATEPSGTQQPAPSTESSGLAQPEHGPNTDLLGTSPKASLELKSSIIGKKKPAAAKKGLGAKKGLGAQKVSSQSFSEIERQAQVAEKLREQQAADAKKQAEESMVASMRLAYQELQIDRKKEEKKLQNLEGKKREQAESSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 857769 - protein, 442 aa, Homo sapiens [sequence omitted]

SEQ ID NO: 857770 - protein, 514 aa, Homo sapiens
MAAEPNKTEIQTLFKRLRAVPTNKACFDCGAKNPSWASITYGVFLCIDCSGVHRSLGVHLSFIRSTELDSNWNWFQLRCMQTAFFRQHGCTANDANTKYNSRAAQMYREKIRQLGSAALARHGTDLWIDNMSSAVPNHSPEKKDSDFFTEHTQPPAWDAPATEPSGTQQPAPSTESSGLAQPEHGPNTDLLGTSPKASLELKSSIIGKKKPAAAKKGLGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 857771 - protein, 442 aa, Homo sapiens [sequence omitted]

SEQ ID NO: 857772 - protein, 535 aa, Homo sapiens
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDLWIDNMSSAVPNHSPEKKDSDFFTEHTQEWLTEASVIWPPFQPPAWDAPATEPSGTQQPAPSTESSGLAQPEHGPNTDLLGTSPKASLELKSSIIGKKKPAAAKKGLGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 857773 - protein, 414 aa, Homo sapiens
TCKEFVTEHYYGLGTSWWESAEVRRHVCGTVCFQERARIEKAYAQQLADWARKWRGTVEKGPQYGTLEKAWHAFFTAAERLSALHLEVREKLQGQDSERVRAWQRGAFHRPVLGGFRESRAAEDGFRKAQKPWLKRLKEVEASKKSYHAARKDEKTAQTRESHAKADSAVSQEQLRKLQERVERCAKEAEKTKAQYEQTLAELHRYTPRYMEDMEQAFETCQAAERQRLLFFKDMLLTLHQHLDLSSSEKFHELHRDLHQGIEAASDEEDLRWWRSTHGPGMAMNWPQFEEWSLDTQRTISRKEKGGRSPDEVTLTSIVPTRDGTAPPPQSPGSPGTGQDEEWSDEESPRKAATGVRVRALYDYAGQEADELSFRAGEELLKMSEEDEQGWCQGQLQSGRIGLYPANYVECVGA

SEQ ID NO: 857774 - protein, 414 aa, Homo sapiens; identical to SEQ ID NO: 857773

SEQ ID NO: 857775 - protein, 521 aa, Homo sapiens; identical to SEQ ID NO: 857766

SEQ ID NO: 857776 - protein, 521 aa, Homo sapiens; identical to SEQ ID NO: 857766

SEQ ID NO: 857777 - protein, 414 aa, Homo sapiens; identical to SEQ ID NO: 857773

SEQ ID NO: 857778 - protein, 386 aa, Homo sapiens
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDLWIDNMSSAVPNHSPEKKDSDFFTEHTQPPAWDAPATEPSGTQQPAPSTESSGLAQPEHGPNTDLLGTSPKASLELKSSIIGKKKPAAAKKGLGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKGNGQCPFLRVRCSLPDSTTTCPALARRSV

SEQ ID NO: 857779 - protein, 414 aa, Homo sapiens; identical to SEQ ID NO: 857773

SEQ ID NO: 857780 - protein, 414 aa, Homo sapiens; identical to SEQ ID NO: 857773

SEQ ID NO: 857781 - protein, 101 aa, Homo sapiens
PKSRLFLRGFAQFQPTRCVSRGRAESLVPLGPEGGRRAEVGYVSGVSVPGLYSGPLTIRSSPPPPRPVSTAAPRIRVGPASRTVFSCALTVPGCTAPWASI

SEQ ID NO: 857782 - protein, 424 aa, Homo sapiens [sequence omitted]

SEQ ID NO: 857783 - protein, 521 aa, Homo sapiens; identical to SEQ ID NO: 857766

SEQ ID NO: 857784 - protein, 521 aa, Homo sapiens; identical to SEQ ID NO: 857766

SEQ ID NO: 857785 - protein, 535 aa, Homo sapiens
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDLWIDNMSSAVPNHSPEKKDSDFFTEHTQPPAWDAPATEPSGTQQPAPSTESSGLAQPEHGPNTDLLGTSPKASLESVYLSAKGALPARELKSSIIGKKKPAAAKKGLGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 857786 - protein, 500 aa, Homo sapiens
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDLWIDNMSSAVPNHSPEKKDSDFFTEHTQPPAWDAPATEPSGTQQPAPSTESSGLAQPEHGPNTDLLGTSPKASLELKSSIIGKKNQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 857787 - protein, 521 aa, Homo sapiens; identical to SEQ ID NO: 857766

SEQ ID NO: 857788 - protein, 521 aa, Homo sapiens; identical to SEQ ID NO: 857766

SEQ ID NO: 857789 - protein, 414 aa, Homo sapiens; identical to SEQ ID NO: 857773

SEQ ID NO: 857790 - protein, 414 aa, Homo sapiens; identical to SEQ ID NO: 857773

SEQ ID NO: 857791 - protein, 377 aa, Homo sapiens
TCKEFVTEHYYGLGTSWWESAEVRRHVCGTVCFQERARIEKAYAQQLADWARKWRGTVEKGPQYGTLEKAWHAFFTAAERLSALHLEVREKLQGQDSERVRAWQRGAFHRPVLGGFRESRAAEDGFRKAQKPWLKRLKEVEASKKSYHAARKDEKTAQTRESHAKADSAVSQEQLRKLQERVERCAKEAEKTKAQYEQTLAELHRYTPRYMEDMEQAFETCQAAERQRLLFFKDMLLTLHQHLDLSSSEKFHELHRDLHQGIEAASDEEDLRWWRSTHGPGMAMNWPQFEEWSLDTQRTISRKEKGGRSPDEVTLTSIVPTRDGTAPPPQSPGSPGTGQDEEWSDEESPRKAATGVRVRALYDYAGQEADELSFRAG

SEQ ID NO: 857792 - protein, 81 aa, Homo sapiens
TGYTFLPYYPSLVPLVSMPKMTAAAALALNCMSLNDSHGQDADTPWLWDGPQLAGIMPSLEACSLNSPPGLVAAHQPALIH

SEQ ID NO: 857793 - protein, 1427 aa, Homo sapiens
RLKIFQIICTCTEHVQIFPCHYFLKIQFDNYLYSIYIELGIISNLEMISSIWEDVHRLDANMQILCHLISDWSIHGVWYLGGAGTNSLQILRDDFTCKYTKHRNVWKMCLFACPGEMGSAWESALGSDITLPLNCVIKPPPNATSSGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGLLFLKLKAQNEREKFAFCSMKGCERIKIKALIPKNAGVSDCTATAYPKFTERAVVDVPMPKKLFGSQLKTKDHFLEVKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 857794 - protein, 914 aa, Homo sapiens
MYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGLLFLKLKAQNEREKFAFCSMKGCERIKIKALIPKNAGVSDCTATAYPKFTERAVVDVPMPKKLFGSQLKTKDHFLEVKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 857795 - protein, 846 aa, Homo sapiens
MYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGKQRTISWRCKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 857796 - protein, 914 aa, Homo sapiens; identical to SEQ ID NO: 857794

SEQ ID NO: 857797 - protein, 914 aa, Homo sapiens; identical to SEQ ID NO: 857794

SEQ ID NO: 857798 - protein, 146 aa, Homo sapiens
MGAAGRQDFLFKAMLTISWLTLTCFPGATSTVAAGCPDQSPELQPWNPGHDQDHHVHIGQGKTLLLTSSATVYSIHISEGGKPISLCCSLFPPLPQSLADRMQVAMSSDGQNKHHMLWVHVGIWLSEITISSELLGMACRRSNLSE

SEQ ID NO: 857799 - protein, 86 aa, Homo sapiens
HMNNWMLGETPLSSPLQIKDVVGYNSLGHCFFTEDGPEERNTFDHCLGLLVKSGTLLPSDRDSKMCKMITEDSYPGYIPKPRQDCK

SEQ ID NO: 857800 - protein, 822 aa, Homo sapiens
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRAISEGRLRKASCLQE

SEQ ID NO: 857801 - protein, 1361 aa, Homo sapiens
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGLLFLKLKAQNEREKFAFCSMKGCERIKIKALIPKNAGVSDCTATAYPKFTERAVVDVPMPKKLFGSQLKTKDHFLEVKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 857802 - protein, 111 aa, Homo sapiens [sequence omitted]

SEQ ID NO: 857803 - protein, 437 aa, Homo sapiens
MYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGEARTLARLGHWRGQDTGEARTLARLG

SEQ ID NO: 857804 - protein, 118 aa, Homo sapiens
LRIELPFSLAFSSMHLFLISPTTCNSVVDMVPFYKAAGSTCYDQLRVNVSVGGRRRGRFECPSKCPAMLLVCRLLFLKLKAQNEREKFAFCSMKGCERIKIKALIPKNAGVSDCTATA

SEQ ID NO: 857805 - protein, 186 aa, Homo sapiens
YRRPTPLGVGNMRLSVAAAISHGRVFRRMGLGPESRIHLLRNLLTGLVRHERIEAPWARVDEMRGYAEKLIDYGKLGDTNERAMRMADFWLTEKDLIPKLFQVLAPRYKDQTGGYTRMLQIPNRSLDRAKMAVIEYKGNCLPPLPLPRRDSHLTLLNQLLQGLRQDLRQSQEASNHSSHTAQTPGI

SEQ ID NO: 857806 - protein, 189 aa, Homo sapiens
LRLRYEAWVVEVGNMRLSVAAAISHGRVFRRMGLGPESRIHLLRNLLTGLVRHERIEAPWARVDEMRGYAEKLIDYGKLGDTNERAMRMADFWLTEKDLIPKLFQVLAPRYKDQTGGYTRMLQIPNRSLDRAKMAVIEYKGNCLPPLPLPRRDSHLTLLNQLLQGLRQDLRQSQEASNHSSHTAQTPGI

SEQ ID NO: 857807 - protein, 187 aa, Homo sapiens
VPASKGRAEVGNMRLSVAAAISHGRVFRRMGLGPESRIHLLRNLLTGLVRHERIEAPWARVDEMRGYAEKLIDYGKLGDTNERAMRMADFWLTEKDLIPKLFQVLAPRYKDQTGGYTRMLQIPNRSLDRAKMAVIEYKGNCLPPLPLPRRDSHLTLLNQLLQGLRQDLRQSQEASNHSSHTAQTPGI

SEQ ID NO: 857808 - protein, 102 aa, Homo sapiens
LRLRYEAWVVEVGNMRLSVAAAISHGRVFRRMGLGPESRIHLLRNLLTGLVRHERIEAPWARVDEMRGYAEKVRSAALLSTLRVWSEGAEPAASGKGPGPTW

SEQ ID NO: 857809 - protein, 178 aa, Homo sapiens
VPASKGRAEVGNMRLSVAAAISHGRVFRRMGLGPESRIHLLRNLLTGLVRHERIEAPWARVDEMRGYAEKLIDYGKLGDTNERAMRMADFWLTEKDLIPKLFQVLAPRYKDQTGGYTRMLQIPNRSLDRAKMAVIEYKGNCLPPLPLPRRDSHLTLLNQLLQGLRQDLRLPFPWVQRL

SEQ ID NO: 857810 - protein, 187 aa, Homo sapiens; identical to SEQ ID NO: 857807

SEQ ID NO: 857811 - protein, 187 aa, Homo sapiens; identical to SEQ ID NO: 857807

SEQ ID NO: 857812 - protein, 187 aa, Homo sapiens; identical to SEQ ID NO: 857807

SEQ ID NO: 857813 - protein, 102 aa, Homo sapiens; identical to SEQ ID NO: 857808

SEQ ID NO: 857814 - protein, 166 aa, Homo sapiens
LRLRYEAWVVEVGNMRLSVAAAISHGRVFRRMGLGPESRIHLLRNLLTGLVRHERIEAPWARVDEMRGYAEKEKDLIPKLFQVLAPRYKDQTGGYTRMLQIPNRSLDRAKMAVIEYKGNCLPPLPLPRRDSHLTLLNQLLQGLRQDLRQSQEASNHSSHTAQTPGI

SEQ ID NO: 857815 - protein, 91 aa, Homo sapiens
VGNMRLSVAAAISHGRVFRRMGLGPESRIHLLRNLLTGLVRHERIEAPWARVDEMRGYAEKVRSAALLSTLRVWSEGAEPAASGKGPGPTW

SEQ ID NO: 857816 - protein, 359 aa, Homo sapiens [sequence omitted]

SEQ ID NO: 857817 - protein, 359 aa, Homo sapiens [sequence omitted]

SEQ ID NO: 857818 - protein, 359 aa, Homo sapiens [sequence omitted]

SEQ ID NO: 857819 - protein, 341 aa, Homo sapiens
MILNSSTEDGIMIPTLYSIIFVVGIFGNSLVVIVIYFYMKLKTVASVFLLNLALADLCFLLTLPLWAVYTAMEYRWPFGNYLCKIASASVSFNLYASVFLLTCLSIDRYLAIVHPMKSRLRRTMLVAKVTCIIIWLLAGLASLPAIIHRNVFFIENTNITVCAFHYESQNSTLPIGLGLTKNILGFLFPFLIILTSYTLIWKALKKAYEIQKNKPRNDDIFKIIMAIVLFFFFSWIPHQIFTFLDVLIQLGIIRDCRIADIVDTAMPITICIAYFNNCLNPLFYGFLGKKFKRYFLQLLKYIPPKAKSHSNLSTKMSTLSYRPSDNVSSSTKKPAPCFEVE

SEQ ID NO: 857820 - protein, 359 aa, Homo sapiens [sequence omitted]

SEQ ID NO: 857821 - protein, 359 aa, Homo sapiens [sequence omitted]

SEQ ID NO: 857822 - protein, 341 aa, Homo sapiens
MILNSSTEDGIKRIQDDCPKAGRHNYIFVMIPTLYSIIFVVGIFGNSLVVIVIYFYMKLKTVASVFLLNLALADLCFLLTLPLWAVYTAMEYRWPFGNYLCKIASASVSFNLYASVFLLTCLSIDRYLAIVHPMKSRLRRTMLVAKVTCIIIWLLAGLASLPAIIHRNVFFIENTNITVCAFHYESQNSTLPIGLGLTKNILGFLFPFLIILTSYTLIWKALKKAYEIQKNKPRNDDIFKIIMAIVLFFFFSWIPHQIFTFLDVLIQLGIIRDCRIADIVDTAMPITICIAYFNNCLNPLFYGFLGKKFKRYFLQLLKYIPPKAKSHSNLSTKPAPCFEVE

SEQ ID NO: 857823 - protein, 412 aa, Homo sapiens
MAENLKGCSVCCKSSWNQLQDLCRLAKLSCPALGISKRNLYDFEVEYLCDYKKIREQEYYLVKWRGYPDSESTWEPRQNLKCVRILKQFHKDLERELLRRHHRSKTPRHLDPSLANYLVQKAKQRRALRRWEQELNAKRSHLGRITVENEVDLDGPPRAFVYINEYRVGEGITLNQVAVGCECQDCLWAPTGGCCPGASLHKFAYNDQGQVRLRAGLPIYECNSRCRCGYDCPNRVVQKGIRYDLCIFRTDDGRGWGVRTLEKIRKNSFVMEYVGEIITSEEAERRGQIYDRQGATYLFDLDYVEDVYTVDAAYYGNISHFVNHSCDPNLQVYNVFIDNLDERLPRIAFFATRTIRAGEELTFDYNMQVDPVDMESTRMDSNFGLAGLPGSPKKRVRIECKCGTESCRKYLF

SEQ ID NO: 857824 - protein, 356 aa, Homo sapiens
MAENLKGCSVCCKSSWNQLQDLCRLAKLSCPALGISKRNLYDFEVEYLCDYKKIREQEYYLVKWRGYPDSESTWEPRQNLKCVRILKQFHKDLERELLRRHHRSKTPRHLDPSLANYLVQKAKQRRALRRWEQELNAKRSHLGRITVENEVDLDGPPRAFVYINEYRVGEGITLNQVAVGCECQDCLWAPTGGCCPGASLHKFAYNDQGQVRLRAGLPIYECNSRCRCGYDCPNRVVQKGIRYDLCIFRTDDGRGWGVRTLEKIRKNSFVMEYVGEIITSEEADGCPASLSLPQEPSGQARSSPLITTCKWTPWTWRAPAWTPTLAWLGSLAPLRSGSVLNASVGLSPAANTSSSP

SEQ ID NO: 857825 - protein, 412 aa, Homo sapiens; identical to SEQ ID NO: 857823

SEQ ID NO: 857826 - protein, 412 aa, Homo sapiens; identical to SEQ ID NO: 857823

SEQ ID NO: 857827 - protein, 460 aa, Homo sapiens
QAATGPAADSKKTCNTRCSLSVGQPVCHFSGDSSPPLVKSVSSDALKLRFYQGRQSVTTYSHRVRQLCRFCCLAKLSCPALGISKRNLYDFEVEYLCDYKKIREQEYYLVKWRGYPDSESTWEPRQNLKCVRILKQFHKDLERELLRRHHRSKTPRHLDPSLANYLVQKAKQRRALRRWEQELNAKRSHLGRITVENEVDLDGPPRAFVYINEYRVGEGITLNQVAVGCECQDCLWAPTGGCCPGASLHKFAYNDQGQVRLRAGLPIYECNSRCRCGYDCPNRVVQKGIRYDLCIFRTDDGRGWGVRTLEKIRKNSFVMEYVGEIITSEEAERRGQIYDRQGATYLFDLDYVEDVYTVDAAYYGNISHFVNHSCDPNLQVYNVFIDNLDERLPRIAFFATRTIRAGEELTFDYNMQVDPVDMESTRMDSNFGLAGLPGSPKKRVRIECKCGTESCRKYLF

SEQ ID NO: 857828 - protein, 412 aa, Homo sapiens; identical to SEQ ID NO: 857823

SEQ ID NO: 857829 - protein, 167 aa, Homo sapiens
DRGQAAKPGSRIKVNSSPHVSPVCCALFLAEIITSEEAERRGQIYDRQGATYLFDLDYVEDVYTVDAAYYGNISHFVNHSCDPNLQVYNVFIDNLDERLPRIAFFATRTIRAGEELTFDYNMQVDPVDMESTRMDSNFGLAGLPGSPKKRVRIECKCGTESCRKYLF

SEQ ID NO: 857830 - protein, 141 aa, Homo sapiens
MELAMDNSYAFNQRSTCNGIPSEKKNNFLVSEDHGQKILSVLQNFREQNVFYDFKIIMKDEIIPCHRCVLAACSDFFRAMFEVNMKERDDGSVTITNLSSKAVKAFLDYAYTGKTKITDDNVEMFFQLSSFSVLLSSCVLL

SEQ ID NO: 857831 - protein, 83 aa, Homo sapiens
SRTVWQGKPYTESGPRRYLGPDGADANVAPPPSSRRPCAGDGPSLRRLAHRQPSQPAPDSATSSRRKQLGAETEISPALCGIV

SEQ ID NO: 857832 - protein, 526 aa, Homo sapiens
MELAMDNSYAFNQRSTCNGIPSEKKNNFLVSEDHGQKILSVLQNFREQNVFYDFKIIMKDEIIPCHRCVLAACSDFFRAMFEVNMKERDDGSVTITNLSSKAVKAFLDYAYTGKTKITDDNVEMFFQLSSFLQVSFLSKACSDFLIKSINLVNCLQLLSISDSYGSTSLFDHALHFVQHHFSLLFKSSDFLEMNFGVLQKCLESDELNVPEEEMVLKVVLSWTKHNLESRQKYLPHLIEKVRLHQLSEETLQDCLFNEESLLKSTNCFDIIMDAIKCVQGSGGLFPDARPSTTEKYIFIHKTEENGENQYTFCYNIKSDSWKILPQSHLIDLPGSSLSSYGEKIFLTGGCKGKCCRTVRLHIAESYHDATDQTWCYCPVKNDFFLVSTMKTPRTMHTSVMALDRLFVIGGKTRGSRDIKSLLDVESYNPLSKEWISVSPLPRGIYYPEASTCQNVIYVLGSEVEITDAFNPSLDCFFKYNATTDQWSELVAEFGQFFHATLIKAVPVNCTLYICDLSTYKVYSFCP

SEQ ID NO: 857833 - protein, 447 aa, Homo sapiens
MFEVNMKERDDGSVTITNLSSKAVKAFLDYAYTGKTKITDDNVEMFFQLSSFLQVSFLSKACSDFLIKSINLVNCLQLLSISDSYGSTSLFDHALHFVQHHFSLLFKSSDFLEMNFGVLQKCLESDELNVPEEEMVLKVVLSWTKHNLESRQKYLPHLIEKVRLHQLSEETLQDCLFNEESLLKSTNCFDIIMDAIKCVQGSGGLFPDARPSTTEKYIFIHKTEENGENQYTFCYNIKSDSWKILPQSHLIDLPGSSLSSYGEKIFLTGGCKGKCCRTVRLHIAESYHDATDQTWCYCPVKNDFFLVSTMKTPRTMHTSVMALDRLFVIGGKTRGSRDIKSLLDVESYNPLSKEWISVSPLPRGIYYPEASTCQNVIYVLGSEVEITDAFNPSLDCFFKYNATTDQWSELVAEFGQFFHATLIKAVPVNCTLYICDLSTYKVYSFCP

SEQ ID NO: 857834 - protein, 447 aa, Homo sapiens; identical to SEQ ID NO: 857833

SEQ ID NO: 857835 - protein, 234 aa, Homo sapiens
MEGQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLWLHKLHLPNTSRDSETAKPSVNGHQKAL

SEQ ID NO: 857836 - protein, 41 aa, Homo sapiens
MEGQDEVSAREQHFHSQVRESTVRGDRGSPDSPACPPGPSV

SEQ ID NO: 857837 - protein, 490 aa, Homo sapiens
MEGQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 857838 - protein, 490 aa, Homo sapiens; identical to SEQ ID NO: 857837

SEQ ID NO: 857839 - protein, 490 aa, Homo sapiens; identical to SEQ ID NO: 857837

SEQ ID NO: 857840 - protein, 367 aa, Homo sapiens
MPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 857841 - protein, 338 aa, Homo sapiens
MLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 857842 - protein, 397 aa, Homo sapiens
MNKKMKMPSSTGFRLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 857843 - protein, 242 aa, Homo sapiens
MTIIMTKYERRSGQASYQQVLDNVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 857844 - protein, 234 aa, Homo sapiens; identical to SEQ ID NO: 857835

SEQ ID NO: 857845 - protein, 490 aa, Homo sapiens; identical to SEQ ID NO: 857837

SEQ ID NO: 857846 - protein, 70 aa, Homo sapiens
LWIHDHPFPFIDVLFHLEVKIGATYVGSCCKELKDILLLHLQDIKGSGHCENFPLSYDGNPEQRRMDPSS

SEQ ID NO: 857847 - protein, 490 aa, Homo sapiens; identical to SEQ ID NO: 857837

SEQ ID NO: 857848 - protein, 121 aa, Homo sapiens
MEGQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHVETGFTVLARMVSIS

SEQ ID NO: 857849 - protein, 490 aa, Homo sapiens; identical to SEQ ID NO: 857837

SEQ ID NO: 857850 - protein, 490 aa, Homo sapiens; identical to SEQ ID NO: 857837

SEQ ID NO: 857851 - protein, 490 aa, Homo sapiens; identical to SEQ ID NO: 857837

SEQ ID NO: 857852 - protein, 367 aa, Homo sapiens; identical to SEQ ID NO: 857840

SEQ ID NO: 857853 - protein, 487 aa, Homo sapiens
MEGQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDPRTPDSRHSCPM

SEQ ID NO: 857854 - protein, 490 aa, Homo sapiens; identical to SEQ ID NO: 857837

SEQ ID NO: 857855 - protein, 490 aa, Homo sapiens; identical to SEQ ID NO: 857837

SEQ ID NO: 857856 - protein, 175 aa, Homo sapiens
KGHLCPAAHTLPACPSHMLSRAALCLDRGSRERHGSSIWVQGASPQTFPPYFKHLTPHFTLSPLPLFAFFFLALILENCNKIFYYLSLPSSLQEACPAAGANHPSGLHMHLDRHAGWVLTPGPLHLCLPRGAGQHTLYNEGSQSTQLQVPVHESSSHRLFMQLSLIYILLSTYPM

SEQ ID NO: 857857 - protein, 138 aa, Homo sapiens
MYKLASCCLLFIGFLNPLLSLPLLDSREISFQLSAPHEDARLTPEELERASLLQILPEMLGAERGDILRKADSSTNIFNPRGNLRKFQDFSGQDPNILLSHLLARIWKPYKKQRRKLRQDLRLWKKEPGLRIFKNYVC

SEQ ID NO: 857858 - protein, 139 aa, Homo sapiens
METNVFHLMLCVTSARTHKSTSLCFGHFNSYPSLPLIHDLLLEISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 857859 - protein, 124 aa, Homo sapiens
MYKLASCCLLFIGFLNPLLSLPLLDSREISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 857860 - protein, 134 aa, Homo sapiens
PSPRRPPVAPKMPIEISPRRLFKILLPKSKHFFTFWVCCSKNCPGMTKGRALYSLEGFLLLRAAVHVEYYISLFAKGWGCASQYKPAGRMWLLAAGNAAGPKGEVLEVKCTLALEDLVQAKEGKNSELILFMVF

SEQ ID NO: 857861 - protein, 692 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLVKAGANVLAKNKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNAGQTPLETARYHNNPEVALLLTKAPQGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCESSTGVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 857862 - protein, 727 aa, Homo sapiens [sequence omitted]

SEQ ID NO: 857863 - protein, 727 aa, Homo sapiens [sequence omitted]

SEQ ID NO: 857864 - protein, 727 aa, Homo sapiens [sequence omitted]

SEQ ID NO: 857865 - protein, 661 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLVKAGANVLAKNKAGDTALHVAAALNHKKVAKILLEAGADTTIVNNAGQTPLETARYHNNPEVALLLTKAPQVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCESSTGVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 857866 - protein, 586 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLVKAGANVLAKNKAGDTALHVAAALNHKKVAKILLEAGADTTIVNNAGQTPLETARYHNNPEVALLLTKAPQVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCESSTGVDQLVVTAGPAAASDSSPPVVRPKEKALNSTATQRLQQELSSSDCTGSRLRNVKVQTALLPMNEAARSDQQAGPCVNRGTVWTLSTVWTLGTVWTLSTVWTLGTVWTLSTVWTL

SEQ ID NO: 857867 - protein, 509 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLVKAGANVLAKNKAGDTALHVAAALNHKKVAKILLEAGADTTIVNNAGQTPLETARYHNNPEVALLLTKAPQVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCESSTGNPHTESPFVQKEHDQQLLYSPALKGSTYARAVGNTGW

SEQ ID NO: 857868 - protein, 307 aa, Homo sapiens [sequence omitted]

SEQ ID NO: 857869 - protein, 692 aa, Homo sapiens; identical to SEQ ID NO: 857861

SEQ ID NO: 857870 - protein, 610 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLVKAGANVLAKNKAGDTALHVAAALNHKKVAKILLEAGADTTIVNNAGQTPLETARYHNNPEVALLLTKAPQVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQMRVLDKLMVERLSAERTECLNRLQQHSDTEKHEGEKRQISLVDELKTWCMLKIQNLEQKLSGDSRACRAKSTPSTCESSTGVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 857871 - protein, 661 aa, Homo sapiens; identical to SEQ ID NO: 857865

SEQ ID NO: 857872 - protein, 444 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLVKAGANVLAKNKAGDTALHVAAALNHKKVAKILLEAGADTTIVNNAGQTPLETARYHNNPEVALLLTKAPQVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQILGDLCKIRLTFVRL

SEQ ID NO: 857873 - protein, 191 aa, Homo sapiens
MAGAAEDARALFRAGVCAALEAWPALQIAVENGFGGVHSQEKAKWLGGAVEDYFMRNADLELDEVEDFLGELLTNEFDTVVEDGSLPQVSQQLQTMFHHFQRGDGAALREMASCITQRKCKVTATALKTARETDEDEDDVDSVEEMEVTATNDGAATDGVCPQPEPSDPDAQTIKEEDIVEDGWTIVRRKK

SEQ ID NO: 857874 - protein, 191 aa, Homo sapiens; identical to SEQ ID NO: 857873

SEQ ID NO: 857875 - protein, 191 aa, Homo sapiens; identical to SEQ ID NO: 857873

SEQ ID NO: 857876 - protein, 191 aa, Homo sapiens; identical to SEQ ID NO: 857873

SEQ ID NO: 857877 - protein, 191 aa, Homo sapiens; identical to SEQ ID NO: 857873

SEQ ID NO: 857878 - protein, 191 aa, Homo sapiens; identical to SEQ ID NO: 857873

SEQ ID NO: 857879 - protein, 175 aa, Homo sapiens
GGEKNYRLGRGWVDNGGRCRRCASSFPGWGLRGPGGLAGLAADLELDEVEDFLGELLTNEFDTVVEDGSLPQVSQQLQTMFHHFQRGDGAALREMASCITQRKCKVTATALKTARETDEDEDDVDSVEEMEVTATNDGAATDGVCPQPEPSDPDAQTIKEEDIVEDGWTIVRRKK

SEQ ID NO: 857880 - protein, 108 aa, Homo sapiens
VHIRTLLEQQIGPKAISNHPHSFSSPALQIAVENGFGGVTATALKTARETDEDEDDVDSVEEMEVTATNDGAATDGVCPQPEPSDPDAQTIKEEDIVEDGWTIVRRKK

SEQ ID NO: 857881 - protein, 201 aa, Homo sapiens
PGRHVDWGRIMAGAAEDARALFRAGVCAALEAWPALQIAVENGFGGVHSQEKAKWLGGAVEDYFMRNADLELDEVEDFLGELLTNEFDTVVEDGSLPQVSQQLQTMFHHFQRGDGAALREMASCITQRKCKVTATALKTARETDEDEDDVDSVEEMEVTATNDGAATDGVCPQPEPSDPDAQTIKEEDIVEDGWTIVRRKK

SEQ ID NO: 857882 - protein, 191 aa, Homo sapiens; identical to SEQ ID NO: 857873

SEQ ID NO: 857883 - protein, 191 aa, Homo sapiens; identical to SEQ ID NO: 857873

SEQ ID NO: 857884 - protein, 208 aa, Homo sapiens
MLHKVELLFSISVTGRVCRVLHRDARALFRAGVCAALEAWPALQIAVENGFGGVHSQEKAKWLGGAVEDYFMRNADLELDEVEDFLGELLTNEFDTVVEDGSLPQVSQQLQTMFHHFQRGDGAALREMASCITQRKCKVTATALKTARETDEDEDDVDSVEEMEVTATNDGAATDGVCPQPEPSDPDAQTIKEEDIVEDGWTIVRRKK

SEQ ID NO: 857885 - protein, 201 aa, Homo sapiens; identical to SEQ ID NO: 857881

SEQ ID NO: 857886 - protein, 644 aa, Homo sapiens
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQLGNFPEPLFDVCKKSSVSKLSTPKERVSRRFGRSFTCDSCGFGFSCEKLLDEHVLTCTNRHLYQNTRSYHRIVDIRDGKDSNIKAEFGEKDSSKTFSAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIENICACGKCGQILVKGRQLQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMASGEIGPSKPVEK

SEQ ID NO: 857887 - protein, 619 aa, Homo sapiens
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQFISAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIENICACGKCGQILVKGRQLQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMARYVCSICDQGNFRKHDHVRHMISHLSAGETICQVCFQIFPNNEQLEQHMDVHLYTCGICGAKFNLRKDMRSHYNAKHLKRT

SEQ ID NO: 857888 - protein, 713 aa, Homo sapiens
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQLGNFPEPLFDVCKKSSVSKLSTPKERVSRRFGRSFTCDSCGFGFSCEKLLDEHVLTCTNRHLYQNTRSYHRIVDIRDGKDSNIKAEFGEKDSSKTFSAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIENICACGKCGQILVKGRQLQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMARYVCSICDQGNFRKHDHVRHMISHLSAGETICQVCFQIFPNNEQLEQHMDVHLYTCGICGAKFNLRKDMRSHYNAKHLKRT

SEQ ID NO: 857889 - protein, 695 aa, Homo sapiens
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQLGNFPEPLFDVCKKSSVSKLSTPKERVSRRFGRSFTCDSCGFGFSCEKLLDEHVLTCTNRHLYQNTRSYHRIVDIRDGKDSNIKAEFGEKDSSKTFSAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIVQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMARYVCSICDQGNFRKHDHVRHMISHLSAGETICQVCFQIFPNNEQLEQHMDVHLYTCGICGAKFNLRKDMRSHYNAKHLKRT

SEQ ID NO: 857890 - protein, 322 aa, Homo sapiens
VSYNDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFANSHAVNTARGE

SEQ ID NO: 857891 - protein, 69 aa, Homo sapiens
SDAAVFYEDPGTIVRSFPELGAGLGLVAEAAAEGDVEAFAKAMQNNAKPEQKEGDTKDKKDEEEDMSLD

SEQ ID NO: 857892 - protein, 389 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFANSHAVNTARGE

SEQ ID NO: 857893 - protein, 436 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQVEAGPRVSSTVCSGSGQGGGGGPAPPSPWPVLHVPDPQSWQLSSVALGCSPGWSSALAWLFLQALGMFSAALASGQLGPLMCQFGLPAEAVEAANKGG

SEQ ID NO: 857894 - protein, 379 aa, Homo sapiens
ISREEEHRESRSSVTVMLSVQPERLLDYSTFCCLDRKYAFVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 857895 - protein, 336 aa, Homo sapiens
FSKIYSFKKSRLYRPEFPDAEVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 857896 - protein, 368 aa, Homo sapiens
MTTSGALFPSLVPGSRGASNKYLVEFRAGKMSLKGTTVTPDKRKGLVYIQQTDDSLIHFCWKDRTSGNVEDEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 857897 - protein, 294 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQMWKRLPKPCRTTPSPSRKRATRRTRRTKRRT

SEQ ID NO: 857898 - protein, 414 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSGALSLRSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 857899 - protein, 134 aa, Homo sapiens [sequence omitted]

SEQ ID NO: 857900 - protein, 455 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLEMLVPLGGIWTESSESKHMNCVMGWNRNDLASRTQPQVSTRPMPLLQACGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 857901 - protein, 134 aa, Homo sapiens [sequence omitted]

SEQ ID NO: 857902 - protein, 134 aa, Homo sapiens [sequence omitted]

SEQ ID NO: 857903 - protein, 254 aa, Homo sapiens
MTTSGALFPSLVPGSRGASNKYLVEFRAGKMSLKGTTVTPDKRKGLVYIQQTDDSLIHFCWKDRTSGNVEDEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQGNVCCRLE

SEQ ID NO: 857904 - protein, 84 aa, Homo sapiens
TAAFLPCGLSHPGVQRVRAGCAAYGAQSAARAAGGAGRTRVSGGARQAPRRKSEPGRRLSNECGREAARNWALAVRCTPSPPTH

SEQ ID NO: 857905 - protein, 69 aa, Homo sapiens; identical to SEQ ID NO: 857891

SEQ ID NO: 857906 - protein, 407 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 857907 - protein, 407 aa, Homo sapiens; identical to SEQ ID NO: 857906

SEQ ID NO: 857908 - protein, 369 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQMWKRLPKPCRTTPSPSRKRATRRTRRTKRRT

SEQ ID NO: 857909 - protein, 363 aa, Homo sapiens
GRVGRRTRGSGRVGRPTRARTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 857910 - protein, 275 aa, Homo sapiens [sequence omitted]

SEQ ID NO: 857911 - protein, 368 aa, Homo sapiens; identical to SEQ ID NO: 857896

SEQ ID NO: 857912 - protein, 442 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGFRGSRVRCSAEAQAAGGARVDLAGAGPPELQCFPGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 857913 - protein, 465 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGNVLPPGLSGSFCWECFEARSLFPLNFCWLCLRSVGEPVLSASWFPFGNALVCLWLELGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 857914 - protein, 245 aa, Homo sapiens
MSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 857915 - protein, 109 aa, Homo sapiens
RLPPFYPVAFPIQASRGLEPAARLTGLNRRRERQAGRAERGFPAGPGRRRGGRASPDGASRTSVGARQDDDLRRALSKPGARLSGRLQQVLGGVSGGKDVPEGDHRDSG

SEQ ID NO: 857916 - protein, 166 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSAKPEQKEGDTKDKKDEEEDMSLD

SEQ ID NO: 857917 - protein, 98 aa, Homo sapiens
MTTSGALFPSLVPGSRGASNKYLVEFRAGKMSLKGTTVTPDKRKGLVYIQQTDDSLIHFCWKDRTSGNVEDVSVPEPQQQDRRLLGPSESSLWSSRWG

SEQ ID NO: 857918 - protein, 110 aa, Homo sapiens
WAGRGTLLPLALPERSWLMELLSWEWREPEQEEGTALCRSHAHCSPPASGPQSGLWKLNCFCCWKTYVIIYPGWTRVVQKVSVCLQGLFPGRDVRLCASRWGVDVDGFCM

SEQ ID NO: 857919 - protein, 344 aa, Homo sapiens
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASECESVSDKAPSPATLPATSSSLPSPATPSHGSPSSHGPPATHPTSPTPPSTASGATTAANGGSLNCLQTPSSTSRGRKMTVNGAPVPPLT

SEQ ID NO: 857920 - protein, 344 aa, Homo sapiens; identical to SEQ ID NO: 857919

SEQ ID NO: 857921 - protein, 409 aa, Homo sapiens
PPLPSLPPSHPPLPETHRTPNPAKRAPRLNDLASPSTTTSLCSSPRADPVPRATLPSPPTPDPGIMHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASECESVSDKAPSPATLPATSSSLPSPATPSHGSPSSHGPPATHPTSPTPPSTASGATTAANGGSLNCLQTPSSTSRGRKMTVNGAPVPPLT

SEQ ID NO: 857922 - protein, 368 aa, Homo sapiens
SGFLIPLPFPRATLPSPPTPDPGIMHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASECESVSDKAPSPATLPATSSSLPSPATPSHGSPSSHGPPATHPTSPTPPSTASGATTAANGGSLNCLQTPSSTSRGRKMTVNGAPVPPLT

SEQ ID NO: 857923 - protein, 266 aa, Homo sapiens
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASELGPPQLPTGVA

SEQ ID NO: 857924 - protein, 266 aa, Homo sapiens
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACNLSTPSTFSGPFFPPLLLSPALPTLGVGGGFYK

SEQ ID NO: 857925 - protein, 344 aa, Homo sapiens; identical to SEQ ID NO: 857919

SEQ ID NO: 857926 - protein, 203 aa, Homo sapiens
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKAVGFLPEASWR

SEQ ID NO: 857927 - protein, 344 aa, Homo sapiens; identical to SEQ ID NO: 857919

SEQ ID NO: 857928 - protein, 456 aa, Homo sapiens
CLSLSWPVTLWGLGWGPAVLRKPRWEGEALSRSCLRTPRAPSVPSPACPVRLSFSLFSVPFSLSSLPRWPKRAPRLNDLASPSTTTSLCSSPRADPVPRATLPSPPTPDPGIMHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASECESVSDKAPSPATLPATSSSLPSPATPSHGSPSSHGPPATHPTSPTPPSTASGATTAANGGSLNCLQTPSSTSRGRKMTVNGAPVPPLT

SEQ ID NO: 857929 - protein, 344 aa, Homo sapiens; identical to SEQ ID NO: 857919

SEQ ID NO: 857930 - protein, 344 aa, Homo sapiens; identical to SEQ ID NO: 857919

SEQ ID NO: 857931 - protein, 344 aa, Homo sapiens; identical to SEQ ID NO: 857919

SEQ ID NO: 857932 - protein, 286 aa, Homo sapiens
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASESEARSPGQDRATASKSTRRQKPVSSDPTPTP

SEQ ID NO: 857933 - protein, 144 aa, Homo sapiens
FAIFSLFVLDFPHLCGFISLWSLMLVTFRWGFCVDVLFVDVDTTPFCLLVFLLTVRPLCCRSAGVCWSSTPDPVCLGITSRGCRTAKIAAFSFLWEASSQRGTCQMPAGALVYEVKSNHGVKRRQAEMMQAAPMLEICSLKFSQ

SEQ ID NO: 857934 - protein, 933 aa, Homo sapiens
MEKECMNGCVQRTKAAVEFPQKTSALAVCFCFLHHGFRTTPIPASPLIPRSSRPLHRPLPGIPIGCVLLRLSIRCTSSVHGCPLALCNTCLHLTAYAPVSRTPPRWPSHWLPAPSGPAPAGPAAGAVGAAAAADMARTAPVEPPLRHSAPPSPAAGEPRTSVEAAVAPRRVLFADEALGLPLAQLRRYRPWGGPGAGKMAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVSDVPMTGNPAEEGDVPRSSPPVAFTEVLQAPAIRIPPSSPLCGLGGSPRDQASGPDASEGATGPFLEPSQQQAEATWGVSSENGGGLEAVSGSEELLGEDTIDQELEQLYLSHLSRLRAAVAAGGAGGGGEGSTDGGMSPSHPLGILTDRDLILKWPGPERALNSALAEEITLHYARLGRGVELIKDTEDPDDEGEGEEGLSVTPSSPEGDSPKESPPEILSGARSVVATMGDVWLPWAEGSGCDGPVVLGTEGQFIGDPEKGMGKDTSSLHMNRVIAGVTESLGEAGTEAQIEVTSEWAGSLDPISGKEPASPVLLQGQNPTLLSPLGAEVCLSSVARPHVSSQDEKDAGPSLEPPKKSPTLAVPAECVCALPPQLRGPLTQTLGVLAGLVVVPVALNSGVSLLVLALCLSLAWFS

SEQ ID NO: 857935 - protein, 567 aa, Homo sapiens
MEKECMNGCVQRTKAAVEFPQKTSALAVCFCFLHHGFRTTPIPASPLIPRSSRPLHRPLPGIPIGCVLLRLSIRCTSSVHGCPLALCNTCLHLTAYAPVSRTPPRWPSHWLPAPSGPAPAGPAAGAVGAAAAADMARTAPVEPPLRHSAPPSPAAGEPRTSVEAAVAPRRVLFADEALGLPLAQLRRYRPWGGPGAGKMAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVCWSLLEFHSRPCLPGYHQQRLQNSKDCCLFLPLGSFVPEGHLPDASRSSCI

SEQ ID NO: 857936 - protein, 545 aa, Homo sapiens
MEKECMNGCVQRTKAAVEFPQKTSALAVCFCFLHHGFRTTPIPASPLIPRSSRPLHRPLPGIPIGCVLLRLSIRCTSSVHGCPLALCNTCLHLTAYAPVSRTPPRWPSHWLPAPSGPAPAGPAAGAVGAAAAADMARTAPVEPPLRHSAPPSPAAGEPRTSVEAAVAPRRVLFADEALGLPLAQLRRYRPWGGPGAGKMAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVKSNHGVKRRQAEMMQAAPMLEICSLKFSQ

SEQ ID NO: 857937 - protein, 535 aa, Homo sapiens
MEKECMNGCVQRTKAAVEFPQKTSALAVCFCFLHHGFRTTPIPASPLIPRSSRPLHRPLPGIPIGCVLLRLSIRCTSSVHGCPLALCNTCLHLTAYAPVSRTPPRWPSHWLPAPSGPAPAGPAAGAVGAAAAADMARTAPVEPPLRHSAPPSPAAGEPRTSVEAAVAPRRVLFADEALGLPLAQLRRYRPWGGPGAGKMAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVSDVPMTGNPAEEGEKQSRS

SEQ ID NO: 857938 - protein, 546 aa, Homo sapiens
MEKECMNGCVQRTKAAVEFPQKTSALAVCFCFLHHGFRTTPIPASPLIPRSSRPLHRPLPGIPIGCVLLRLSIRCTSSVHGCPLALCNTCLHLTAYAPVSRTPPRWPSHWLPAPSGPAPAGPAAGAVGAAAAADMARTAPVEPPLRHSAPPSPAAGEPRTSVEAAVAPRRVLFADEALGLPLAQLRRYRPWGGPGAGKMAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQLLEFVGVPLQSLFTSYTRAPAGIWQCPSGTK

SEQ ID NO: 857939 - protein, 217 aa, Homo sapiens
AAAVVGRGGGCLAGTQAEPRIQDGISCSCSSRSCPRRAARDVARFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVCWSLLEFHSRPCLPGYHQQRLQNSKDCCLFLPLGSFVPEGHLPDASRSSCI

SEQ ID NO: 857940 - protein, 190 aa, Homo sapiens [sequence omitted]

SEQ ID NO: 857941 - protein, 305 aa, Homo sapiens
DIPPLSGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMADYQQPLMIGTGTVTRKGSTFRPMDTDAEEAGVSTDAGGHYDCPQRAGRHEYALPLAPPEPEYATPIVERHVLRAHTFSAQSGYRVPGPQPGHKHSLSSGGFSPVAGVGAQDGDYQRPHSAQPADRGYDRPKAVSALATESGHPDSQKPPTHPGTSDSYSAPRDCLTPLNQTAMTALL

SEQ ID NO: 857942 - protein, 140 aa, Homo sapiens
DIPPLSGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMAASPEPVSEPLPP

SEQ ID NO: 857943 - protein, 190 aa, Homo sapiens [sequence omitted]

SEQ ID NO: 857944 - protein, 129 aa, Homo sapiens
DIPPLSGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMAG

SEQ ID NO: 857945 - protein, 398 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQNEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 857946 - protein, 444 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKAGKFSIIPTIINVGSGVALMGAGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 857947 - protein, 348 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSNRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 857948 - protein, 432 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRLRTPSASPLHQE

SEQ ID NO: 857949 - protein, 422 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 857950 - protein, 178 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPE

SEQ ID NO: 857951 - protein, 422 aa, Homo sapiens; identical to SEQ ID NO: 857949

SEQ ID NO: 857952 - protein, 370 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSNRLDNKLSKSVSSGYNFRFARYYRDAAGVEFRTLMKAYGIRFDVMVNGKAGKFSIIPTIINVGSGVALMGAGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 857953 - protein, 104 aa, Homo sapiens
RQAVAAGEGGPAKSPAPRDSVFSELAVAHRQAVAAGEGGPAKSPAPRDSVFSELAVAHRQAVAALRPRAVSESQTWHLLCGSESLGHQPKVRQRDPLWHMLAGV

SEQ ID NO: 857954 - protein, 372 aa, Homo sapiens
MSGRSGKKKMSKLSRSARAGVIFPVGRLMRYLKKGTFKYRISVGAPVYMAAVIEYLAAEILELAGNAARDNKKARIAPRHILLAVANDEELNQLLKGVTIASGGVLPRIHPELLAKKRGTKGKSETILSPPPEKRGRKATSGKKGGKKSKAAKPRTSKKSKPKDSDKEGTSNSTSEDGPGDGFTILSSKSLVLGQKLSLTQSDISHIGSMRVEGIVHPTTAEIDLKEDIGKALEKAGGKEFLETVKELRKSQGPLEVAEAAVSQSSGLAAKFVIHCHIPQWGSDKCEEQLEETIKNCLSAAEDKKLKSVAFPPFPSGRNCFPKQTAAQVTLKAISAHFDDSSASSLKNVYFLLFDSESIGIYVQEMAKLDAK

SEQ ID NO: 857955 - protein, 372 aa, Homo sapiens; identical to SEQ ID NO: 857954

SEQ ID NO: 857956 - protein, 178 aa, Homo sapiens [sequence omitted]

SEQ ID NO: 857957 - protein, 372 aa, Homo sapiens; identical to SEQ ID NO: 857954

SEQ ID NO: 857958 - protein, 317 aa, Homo sapiens
MSAEILELAGNAARDNKKARIAPRHILLAVANDEELNQLLKGVTIASGGVLPRIHPELLAKKRGTKGKSETILSPPPEKRGRKATSGKKGGKKSKAAKPRTSKKSKPKDSDKEGTSNSTSEDGPGDGFTILSSKSLVLGQKLSLTQSDISHIGSMRVEGIVHPTTAEIDLKEDIGKALEKAGGKEFLETVKELRKSQGPLEVAEAAVSQSSGLAAKFVIHCHIPQWGSDKCEEQLEETIKNCLSAAEDKKLKSVAFPPFPSGRNCFPKQTAAQVTLKAISAHFDDSSASSLKNVYFLLFDSESIGIYVQEMAKLDAK

SEQ ID NO: 857959 - protein, 372 aa, Homo sapiens; identical to SEQ ID NO: 857954

SEQ ID NO: 857960 - protein, 120 aa, Homo sapiens
MFLSYVPAAVSQSSGLAAKFVIHCHIPQWGSDKCEEQLEETIKNCLSAAEDKKLKSVAFPPFPSGRNCFPKQTAAQVTLKAISAHFDDSSASSLKNVYFLLFDSESIGIYVQEMAKLDAK

SEQ ID NO: 857961 - protein, 372 aa, Homo sapiens; identical to SEQ ID NO: 857954

SEQ ID NO: 857962 - protein, 455 aa, Homo sapiens
NLLGTIQKWRQQVLTLRVHVRQWCDHTCLPYDDPWSSIVPVESRRTSEGRRPRGLRYVPEKSTPEFEVRRRARVYMRSYRSIEVRELSIEYKMSKLSRSARAGVIFPVGRLMRYLKKGTFKYRISVGAPVYMAAVIEYLAAEILELAGNAARDNKKARIAPRHILLAVANDEELNQLLKGVTIASGGVLPRIHPELLAKKRGTKGKSETILSPPPEKRGRKATSGKKGGKKSKAAKPRTSKKSKPKDSDKEGTSNSTSEDGPGDGFTILSSKSLVLGQKLSLTQSDISHIGSMRVEGIVHPTTAEIDLKEDIGKALEKAGGKEFLETVKELRKSQGPLEVAEAAVSQSSGLAAKFVIHCHIPQWGSDKCEEQLEETIKNCLSAAEDKKLKSVAFPPFPSGRNCFPKQTAAQVTLKAISAHFDDSSASSLKNVYFLLFDSESIGIYVQEMAKLDAK

SEQ ID NO: 857963 - protein, 372 aa, Homo sapiens; identical to SEQ ID NO: 857954

SEQ ID NO: 857964 - protein, 285 aa, Homo sapiens
MHFSLQLLKGVTIASGGVLPRIHPELLAKKRGTKGKSETILSPPPEKRGRKATSGKKGGKKSKAAKPRTSKKSKPKDSDKEGTSNSTSEDGPGDGFTILSSKSLVLGQKLSLTQSDISHIGSMRVEGIVHPTTAEIDLKEDIGKALEKAGGKEFLETVKELRKSQGPLEVAEAAVSQSSGLAAKFVIHCHIPQWGSDKCEEQLEETIKNCLSAAEDKKLKSVAFPPFPSGRNCFPKQTAAQVTLKAISAHFDDSSASSLKNVYFLLFDSESIGIYVQEMAKLDAK

SEQ ID NO: 857965 - protein, 358 aa, Homo sapiens
AACELPPTRCGASGSRPPSGSDPANGFGYIFMLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 857966 - protein, 358 aa, Homo sapiens; identical to SEQ ID NO: 857965

SEQ ID NO: 857967 - protein, 291 aa, Homo sapiens
MAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 857968 - protein, 291 aa, Homo sapiens; identical to SEQ ID NO: 857967

SEQ ID NO: 857969 - protein, 291 aa, Homo sapiens; identical to SEQ ID NO: 857967

SEQ ID NO: 857970 - protein, 291 aa, Homo sapiens; identical to SEQ ID NO: 857967

SEQ ID NO: 857971 - protein, 123 aa, Homo sapiens
MAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKDWSSCLL

SEQ ID NO: 857972 - protein, 331 aa, Homo sapiens
AACELPPTRCGASGSRPPSGSDPANGFGYIFMLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPDLYGNLGHPLS

SEQ ID NO: 857973 - protein, 341 aa, Homo sapiens
AACELPPTRCGASGSRPPSGSDPANGFGYIFMLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPL

SEQ ID NO: 857974 - protein, 332 aa, Homo sapiens
AACELPPTRCGASGSRPPSGSDPANGFGYIFMLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDATMS

SEQ ID NO: 857975 - protein, 163 aa, Homo sapiens
MAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGMPL

SEQ ID NO: 857976 - protein, 123 aa, Homo sapiens
MAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSNQASALPE

SEQ ID NO: 857977 - protein, 118 aa, Homo sapiens
MAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQFQKGGILYSHCLFHGN

SEQ ID NO: 857978 - protein, 118 aa, Homo sapiens
SALSGDKFLPRGLYTFAGGVGPIVVPPRTIEGALRRLPPVRLFPLYTRFLNRRALVSCSFKLRASLVRGPPCVHKPTRGAIGPPRGNFFAPPPFFFFFFFFFFFFFFFLYSHCLFHGN

SEQ ID NO: 857979 - protein, 139 aa, Homo sapiens
SGLRVTAHSLRRFWLQTALRIGPCEWFWLYLHVGPTPYPVGRGESHLRCFNLCNRDAASGRGGEGRANWSGRREGGGRGAAWGLGSFAPCPPGRGGRRERVNFPLRDSGERGNMLRVSKAAQVHSQGESLGKTKDSSRR

SEQ ID NO: 857980 - protein, 111 aa, Homo sapiens [sequence omitted]

SEQ ID NO: 857981 - protein, 358 aa, Homo sapiens; identical to SEQ ID NO: 857965

SEQ ID NO: 857982 - protein, 291 aa, Homo sapiens; identical to SEQ ID NO: 857967

SEQ ID NO: 857983 - protein, 327 aa, Homo sapiens
AACELPPTRCGASGSRPPSGSDPANGFGYIFIRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 857984 - protein, 276 aa, Homo sapiens
MAISSSSCELPLVAVCQVTSTPDKQQNFKTCAELVREAARLGACLAFLPEAFDFIARDPAETLHLSEPLGGKLLEEYTQLARECGLWLSLGGFHERGQDWEGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 857985 - protein, 332 aa, Homo sapiens; identical to SEQ ID NO: 857974

SEQ ID NO: 857986 - protein, 123 aa, Homo sapiens; identical to SEQ ID NO: 857971

SEQ ID NO: 857987 - protein, 274 aa, Homo sapiens
AACELPPTRCGASGSRPPSGSDPANGFGYIFMLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEPVSS

SEQ ID NO: 857988 - protein, 123 aa, Homo sapiens; identical to SEQ ID NO: 857971

SEQ ID NO: 857989 - protein, 139 aa, Homo sapiens; identical to SEQ ID NO: 857979

SEQ ID NO: 857990 - protein, 147 aa, Homo sapiens
MSPWGPLIFLDRSGDHEIKHPRAIPTNTSHPPLASPPLFTIPTDTLYATLVCNICQSHQFTSSTGNTKPTIRMVYLHVPLHPPYPLSPFTTSHPSYHLLTNCTLPPLIRPTPLNIKIHSPPTDHALVSFAHTPPQKTVYLPPIPHHI

SEQ ID NO: 857991 - protein, 187 aa, Homo sapiens
MVCSPVTLRIAPPDRRFSRSAIPEQIISSTLSSPSSNAPDPCAKETVLSALKEKKKKRTVEEEDQIFLDGQENKRSCLVDGLTDASSAFKVPRPGPDTLQFTVDVFHFANDSRNMIYITCHLKVTLAEQDPDELNKACSFSKPSNSWFPVEGPADICQCCNKGDCGTPSHSRRQPRVVSQWSTSASL

SEQ ID NO: 857992 - protein, 135 aa, Homo sapiens
MVQFWLTTPSASQIQAILLPQPPDCLVDGLTDASSAFKVPRPGPDTLQFTVDVFHFANDSRNMIYITCHLKVTLAEQDPDELNKACSFSKPSNSWFPVEGPADICQCCNKGDCGTPSHSRRQPRVVSQWSTSASL

SEQ ID NO: 857993 - protein, 115 aa, Homo sapiens
MVCSPVTLRIAPPDRRFSRSAIPEQIISSTLSSPSSNAPDPCAKETVLSALKEKKKKRTVEEEDQIFLDGQENKRSCLVDGLTDASSAFKVPRPGPDTLQFTVDVFHFANDSRNM

SEQ ID NO: 857994 - protein, 187 aa, Homo sapiens; identical to SEQ ID NO: 857991

SEQ ID NO: 857995 - protein, 187 aa, Homo sapiens; identical to SEQ ID NO: 857991

SEQ ID NO: 857996 - protein, 187 aa, Homo sapiens; identical to SEQ ID NO: 857991

SEQ ID NO: 857997 - protein, 187 aa, Homo sapiens; identical to SEQ ID NO: 857991

SEQ ID NO: 857998 - protein, 132 aa, Homo sapiens
MVCSPVTLRIAPPDRRFSRSAIPEQIISSTLSSPSSNAPDPCAKETVLSALKEKKKKRTVEEEDQIFLDGQENKRSCLVDGLTDASSAFKVPRPGPDTLQFTVDVFHFANDSRNMRRFSRSAIPGRAVGFAF

SEQ ID NO: 857999 - protein, 422 aa, Homo sapiens
NKKEEKLEDMDFLEDVDFPGRSGFGGRPVIAGRLDLLEDLIYWKTWSFLEDMDCPEDMDRLEDVDFLEAQDYLEEHEIDGRLEVAGRPGVVGRPCHRCHRKPWILQTLEDLNVRRSAHWRRWKTWILSQLMEDWVVVGRHEDAGRHRDAGRRGDVGRRADAGSPGDAGRPGDIGRHGFVGRRSLVGRHIFLEDVDFLEDMAWLEDVDFLEDVPLLEDIPLLEDVPLLEDVPLLEDTSRLEDINLMEDMALLEDVDLLEDTDFLEDLDFSEAMDLREDKDFLEDMDSLEDMALLEDVDLLEDTDFLEDPDFLEAIDLREDKDFLEDMDSLEDLRPLEDVDFLEDMAFLEDVDFQEDPNYPEDLDCWEDVDFLEDWRLLEDMDFLEDMDFLEDVDLQEDIYWLEDLDFFRKMWIDWKTWIWWKT

SEQ ID NO: 858000 - protein, 109 aa, Homo sapiens
AESFGGGDRDVEGGDRFTLIREYRLRVRKASRSDLGLWRATRGLVFQVRRFRLDGRQEVTDLSSDVAPPAAALISSASYPSAQLDPPQPRPRPWTLGVPEGAATSSRVK

SEQ ID NO: 858001 - protein, 289 aa, Homo sapiens
MIINWNQVSVLWKCLLKQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 858002 - protein, 336 aa, Homo sapiens
AESFGGGDRDVEGGDRFTLIREYRLRVRKASRSDLGLWRATRGLVFQSLPPRMTSVTRSEIIDEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 858003 - protein, 340 aa, Homo sapiens
MSKTHDHQLESSLSPVEVFAKTSASLEMNQGVSEERIHLGSSPKKGGNCDLSHQERLQSKSLHLSPQEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 858004 - protein, 408 aa, Homo sapiens
AESFGGGDRDVEGGDRFTLIREYRLRVRKASRSDLGLWRATRGLVFQSLPPRMTSVTRSEIIDEKGPVMSKTHDHQLESSLSPVEVFAKTSASLEMNQGVSEERIHLGSSPKKGGNCDLSHQERLQSKSLHLSPQEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 858005 - protein, 146 aa, Homo sapiens
MKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 858006 - protein, 296 aa, Homo sapiens
AESFGGGDRDVEGGDRFTLIREYRLRVRKASRSDLGLWRATRGLVFQSLPPRMTSVTRSEIIDEKGPVMSKTHDHQLESSLSPVEVFAKTSASLEMNQGVSEERIHLGSSPKKGGNCDLSHQERLQSKSLHLSPQEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRTS

SEQ ID NO: 858007 - protein, 123 aa, Homo sapiens
SKTHDHQLESSLSPVEVFAKTSASLEMNQGVSEERIHLGSSPKKGGNCDLSHQERLQSKSLHLSPQEQSASYQDRRQSWRRASMKETNRRKSLHPIHQGITGGVLCTQDSEVPAQIRDRFQLR

SEQ ID NO: 858008 - protein, 408 aa, Homo sapiens; identical to SEQ ID NO: 858004

SEQ ID NO: 858009 - protein, 485 aa, Homo sapiens
AESFGGGDRDVEGGDRFTLIREYRLRVRKASRSDLGLWRATRGLVFQSLPPRMTSVTRSEIIDGKYCSEIQYLLPWVQASELYPNLSWLLVDLESHTHYLQRCFLYVSTIYGAYIYFFHFFAQIVVAGLILYFDFFITNTEKGPVMSKTHDHQLESSLSPVEVFAKTSASLEMNQGVSEERIHLGSSPKKGGNCDLSHQERLQSKSLHLSPQEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 858010 - protein, 301 aa, Homo sapiens
AESFGGGDRDVEGGDRFTLIREYRLRVRKASRSDLGLWRATRGLVFQSLPPRMTSVTRSEIIDELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 858011 - protein, 146 aa, Homo sapiens; identical to SEQ ID NO: 858005

SEQ ID NO: 858012 - protein, 110 aa, Homo sapiens
AESFGGGDRDVEGGDRFTLIREYRLRVRKASRSDLGLWRATRGLVFQSLPPRMTSVTRSEIIDGKYCSEIQYLLPWVQASELYPNLSWLLVDLESHTHYLQRCFLYVSTI

SEQ ID NO: 858013 - protein, 666 aa, Homo sapiens
MEQEPQNGEPAEIKIIREAYKKAFLFVNKGLNTDELGQKEEAKNYYKQGIGHLLRGISISSKESEHTGPGWESARQMQQKMKETLQNVRTRLEILEKGLATSLQNDLQEVPKLYPEFPPKDMCEKLPEPQSFSSAPQHAEVNGNTSTPSAGAVAAPASLSLPSQSCPAEAPPAYTPQAAEGHYTVSYGTDSGEFSSVGEEFYRNHSQPPPLETLGLDADELILIPNGVQIFFVNPAGEVSAPSYPGYLRIVRFLDNSLDTVLNRPPGFLQVCDWLYPLVPDRSPVLKCTAGAYMFPDTMLQAAGCFVGVVLSSELPEDDRELFEDLLRQMSDLRLQANWNRAEEENEFQIPGRTRPSSDQLKEASGTDVKQLDQGNKDVRHKGKRGKRAKDTSSEEVNLSHIVPCEPVPEEKPKELPEWSEKVAHNILSGASWVSWGLVKGAEITGKAIQKGASKLRERIQPEEKPVEVSPAVTKGLYIAKQATGGAAKVSQFLVDGVCTVANCVGKELAPHVKKHGSKLVPESLKKDKDGKSPLDGAMVVAASSVQGFSTVWQGLECAAKCIVNNVSAETVQTVRYKYGYNAGEATHHAVDSAVNVGVTAYNINNIGIKAMVKKTATQTGHTLLEDYQIVDNSQRENQEGAANVNVRGEKDEQTKEVKEAKKKDK

SEQ ID NO: 858014 - protein, 666 aa, Homo sapiens; identical to SEQ ID NO: 858013

SEQ ID NO: 858015 - protein, 666 aa, Homo sapiens; identical to SEQ ID NO: 858013

SEQ ID NO: 858016 - protein, 666 aa, Homo sapiens; identical to SEQ ID NO: 858013

SEQ ID NO: 858017 - protein, 666 aa, Homo sapiens; identical to SEQ ID NO: 858013

SEQ ID NO: 858018 - protein, 176 aa, Homo sapiens [sequence omitted]

SEQ ID NO: 858019 - protein, 96 aa, Homo sapiens
RTRGSTHAYGYNAGEATHHAVDSAVNVGVTAYNINNIGIKAMVKKTATQTGHTLLEDYQIVDNSQRENQEGAANVNVRGEKDEQTKEVKEAKKKDK

SEQ ID NO: 858020 - protein, 541 aa, Homo sapiens
MEQEPQNGEPAEIKIIREAYKKAFLFVNKGLNTDELGQKEEAKNYYKQGIGHLLRGISISSKESEHTGPGWESARQMQQKMKETLQNVRTRLEILEKGLATSLQNDLQEVPKLYPEFPPKDMCEKLPEPQSFSSAPQHAEVNGNTSTPSAGAVAAPASLSLPSQSCPAEAPPAYTPQAAEGHYTVSYGTDSGEFSSVGEEFYRNHSQPPPLETLGLDADELILIPNGVQIFFVNPAGEVSAPSYPGYLRIVRFLDNSLDTVLNRPPGFLQVCDWLYPLVPDRSPVLKCTAGAYMFPDTMLQAAGCFVGVVLSSELPEDDRELFEDLLRQMSDLRLQANWNRAEEENEFQIPGRTRPSSDQLKEASGTDVKQLDQGNKDVRHKGKRGKRAKDTSSEEVNLSHIVPCEPVPEEKPKELPEWSEKVAHNILSGASWVSWGLVKGAEITGKAIQKGASKLRERIQPEEKPVEVSPAVTKGLYIAKQATGGAAKVSQFLVDGVCTVANCVGKELAPHVKKHGSKLVPESLKKDKDGKSPLDGAMGW

SEQ ID NO: 858021 - protein, 66 aa, Homo sapiens
EGIISLYCLSCTVPSAPSSGYKRSLPTLSTRLSGGLGFAGEKEIAQARSSRRGRRGPCLGGSARGR

SEQ ID NO: 858022 - protein, 666 aa, Homo sapiens; identical to SEQ ID NO: 858013

SEQ ID NO: 858023 - protein, 666 aa, Homo sapiens; identical to SEQ ID NO: 858013

SEQ ID NO: 858024 - protein, 666 aa, Homo sapiens; identical to SEQ ID NO: 858013

SEQ ID NO: 858025 - protein, 128 aa, Homo sapiens [sequence omitted]

SEQ ID NO: 858026 - protein, 440 aa, Homo sapiens
MEQEPQNGEPAEIKIIREAYKKAFLFVNKGLNTDELGQKEEAKNYYKQGIGHLLRGISISSKESEHTGPGWESARQMQQKMKETLQNVRTRLEILEKGLATSLQNDLQEVPKLYPEFPPKDMCEKLPEPQSFSSAPQHAEVNGNTSTPSAGAVAAPASLSLPSQSCPAEAPPAYTPQAAEGHYTVSYGTDSGEFSSVGEEFYRNHSQPPPLETLGLDADELILIPNGVQIFFVNPAGEVSAPSYPGYLRIVRFLDNSLDTVLNRPPGFLQVCDWLYPLVPDRSPVLKCTAGAYMFPDTMLQAAGCFVGVVLSSELPEDDRELFEDLLRQMSDLRLQANWNRAEEENEFQIPGRTRPSSDQLKEASGTDVKQLDQGNKDVRHKGKRGKRAKDTSSEEVNLSHIVPCEPVPEEKPKELPEWSEKVAHNILSGITVMLIFFPV

SEQ ID NO: 858027 - protein, 101 aa, Homo sapiens
WKPMCISVQERMVGLVGGAPAKGELIQKHSGICLPLLFQRRFPYIRNSSLRIPIPEAATGYRTGSPPTEKSRGAKQSLISLRFHKPDPHKLRSSSSHCRCG

SEQ ID NO: 858028 - protein, 558 aa, Homo sapiens
MVDSGTEARARGKAEAGLQDGISGPATARVNGKTQAEAVAEAELKTESVTQAKAGDGAMTRTHTVTYREAMAVTREVIKVEDTTKTRVMVETKTKPLAERSIVPQTKSKAMPMSRVSTVTKSEVKVVAVIEANIRSYAKSHDKANTGSRPDRREETSIGMKSSDEDEENICSWFWTGEEPSVGSWFWPEEETSLQVYKPLPKIQEKPKPTHKPTLTIKQKVIAWSRARYIVLVPVEGGEQSLPPEGNWTLVETLIETPLGIRPLTKIPPYHGPYYQTLAEIKKQIRQREKYGPNPKACHCKSRGFSLEPKEFDKLVALLKLTKDPFIHEIATMIMGISPAYPFTQDIIHDVGITVMIENLVNNPNVKEHPGALSMVDDSSESSEEPKSGESYIHQVCKGIISCPLNSPVQLAGLKLLGHLSIKFEDHYVITSYIPDFLTLLNKGSVKTKFYVLKVFSCLSKNHANTRELISAKVLSSLVAPFNKNESKANILNIIEIFENINFQFKTKAKLFTKEKFTKSELISIFQEAKQFGQKLQDLAEHSDPEVRDKVIRLILKL

SEQ ID NO: 858029 - protein, 838 aa, Homo sapiens
MTGAEIEPSAQAKPEKKAGEEVIAGPERENDVPLVVRPKVRTQATTGARPKTETKSVPAARPKTEAQAMSGARPKTEVQVMGGARPKTEAQGITGARPKTDARAVGGARSKTDAKAIPGARPKDEAQAWAQSEFGTEAVSQAEGVSQTNAVAWPLATAESGSVTKSKGLSMDRELVNVDAETFPGTQGQKGIQPWFGPGEETNMGSWCYSRPRAREEASNESGFWSADETSTASSFWTGEETSVRSWPREESNTRSRHRAKHQTNPRSRPRSKQEAYVDSWSGSEDEASNPFSFWVGENTNNLFRPRVREEANIRSKLRTNREDCFESESEDEFYKQSWVLPGEEANSRFRHRDKEDPNTALKLRAQKDVDSDRVKQEPRFEEEVIIGSWFWAEKEASLEGGASAICESEPGTEEGAIGGSAYWAEEKSSLGAVAREEAKPESEEEAIFGSWFWDRDEACFDLNPCPVYKVSDRFRDAAEELNASSRPQTWDEVTVEFKPGLFHGVGFRSTSPFGIPEEASEMLEAKPKNLELSPEGEEQESLLQPDQPSPEFTFQYDPSYRSVREIREHLRARESAESESWSCSCIQCELKIGSEEFEEFLLLMDKIRDPFIHEISKIAMGMRSASQFTRDFIRDSGVVSLIETLLNYPSSRVRTSFLENMIHMAPPYPNLNMIETFICQVCEETLAHSVDSLEQLTGIRMLRHLTMTIDYHTLIANYMSGFLSLLTTANARTKFHVLKMLLNLSENPAVAKKLFSAKALSIFVGLFNIEETNDNIQIVIKMFQNISNIIKSGKMSLIDDDFSLEPLISAFREFEELAKQLQAQIDNQNDPEVGQQS

SEQ ID NO: 858030 - protein, 838 aa, Homo sapiens; identical to SEQ ID NO: 858029

SEQ ID NO: 858031 - protein, 838 aa, Homo sapiens; identical to SEQ ID NO: 858029

SEQ ID NO: 858032 - protein, 838 aa, Homo sapiens; identical to SEQ ID NO: 858029

SEQ ID NO: 858033 - protein, 838 aa, Homo sapiens; identical to SEQ ID NO: 858029

SEQ ID NO: 858034 - protein, 558 aa, Homo sapiens; identical to SEQ ID NO: 858028

SEQ ID NO: 858035 - protein, 558 aa, Homo sapiens; identical to SEQ ID NO: 858028

SEQ ID NO: 858036 - protein, 558 aa, Homo sapiens; identical to SEQ ID NO: 858028

SEQ ID NO: 858037 - protein, 101 aa, Homo sapiens; identical to SEQ ID NO: 858027

SEQ ID NO: 858038 - protein, 101 aa, Homo sapiens; identical to SEQ ID NO: 858027

SEQ ID NO: 858039 - protein, 101 aa, Homo sapiens; identical to SEQ ID NO: 858027

SEQ ID NO: 858040 - protein, 101 aa, Homo sapiens; identical to SEQ ID NO: 858027

SEQ ID NO: 858041 - protein, 132 aa, Homo sapiens
TSVTLAPLCAAALFPPGRVPRPFSVFPVFCVFVLPLPRALARALLLPSLSSLVAPFNKNESKANILNIIEIFENINFQFKTKAKLFTKEKFTKSELISIFQEAKQFGQKLQDLAEHSDPEVRDKVIRLILKL

SEQ ID NO: 858042 - protein, 558 aa, Homo sapiens; identical to SEQ ID NO: 858028

SEQ ID NO: 858043 - protein, 838 aa, Homo sapiens; identical to SEQ ID NO: 858029

SEQ ID NO: 858044 - protein, 838 aa, Homo sapiens; identical to SEQ ID NO: 858029

SEQ ID NO: 858045 - protein, 838 aa, Homo sapiens; identical to SEQ ID NO: 858029

SEQ ID NO: 858046 - protein, 558 aa, Homo sapiens; identical to SEQ ID NO: 858028

SEQ ID NO: 858047 - protein, 709 aa, Homo sapiens
MTGAEIEPSAQAKPEKKAGEEVIAGPERENDVPLVVRPKVRTQATTGARPKTETKSVPAARPKTEAQAMSGARPKTEVQVMGGARPKTEAQGITGARPKTDARAVGGARSKTDAKAIPGARPKDEAQAWAQSEFGTEAVSQAEGVSQTNAVAWPLATAESGSVTKSKGLSMDRELVNVDAETFPGTQGQKGIQPWFGPGEETNMGSWCYSRPRAREEASNESGFWSADETSTASSFWTGEETSVRSWPREESNTRSRHRAKHQTNPRSRPRSKQEAYVDSWSGSEDEASNPFSFWVGENTNNLFRPRVREEANIRSKLRTNREDCFESESEDEFYKQSWVLPGEEANSRFRHRDKEDPNTALKLRAQKDVDSDRVNKNPGLRRKSLLGPGSGQKKRPVWRVELQQSVNLSQESLLQPDQPSPEFTFQYDPSYRSVREIREHLRARESAESESWSCSCIQCELKIGSEEFEEFLLLMDKIRDPFIHEISKIAMGMRSASQFTRDFIRDSGVVSLIETLLNYPSSRVRTSFLENMIHMAPPYPNLNMIETFICQVCEETLAHSVDSLEQLTGIRMLRHLTMTIDYHTLIANYMSGFLSLLTTANARTKFHVLKMLLNLSENPAVAKKLFSAKALSIFVGLFNIEETNDNIQIVIKMFQNISNIIKSGKMSLIDDDFSLEPLISAFREFEELAKQLQAQIDNQNDPEVGQQS

SEQ ID NO: 858048 - protein, 101 aa, Homo sapiens; identical to SEQ ID NO: 858027

SEQ ID NO: 858049 - protein, 101 aa, Homo sapiens; identical to SEQ ID NO: 858027

SEQ ID NO: 858050 - protein, 350 aa, Homo sapiens [sequence omitted]

SEQ ID NO: 858051 - protein, 350 aa, Homo sapiens [sequence omitted]

SEQ ID NO: 858052 - protein, 350 aa, Homo sapiens [sequence omitted]

SEQ ID NO: 858053 - protein, 350 aa, Homo sapiens [sequence omitted]

SEQ ID NO: 858054 - protein, 350 aa, Homo sapiens [sequence omitted]

SEQ ID NO: 858055 - protein, 315 aa, Homo sapiens
MDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGDQYDVCAICLDEYEDGDKLRVLPCAHAYHSRCVDPWLTQTRKTCPICKQPVHRGPGDEDQEEETQGQEEGDEGEPRDHPASERTPLLGSSPTLPTSFGSLAPAPLVFPGPSTDPPLSPPSSPVILV

SEQ ID NO: 858056 - protein, 350 aa, Homo sapiens [sequence omitted]

SEQ ID NO: 858057 - protein, 350 aa, Homo sapiens [sequence omitted]

SEQ ID NO: 858058 - protein, 243 aa, Homo sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGEGVRGEEGFSHSLPGSEGL

SEQ ID NO: 858059 - protein, 308 aa, Homo sapiens
MHPAAFPLPVVVAAVLWGAAPTRGLIRATSDHNASMDFADLPALFGATLSQEGLQVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGDQYDVCAICLDEYEDGDKLRVLPCAHAYHSRCVDPWLTQTRKTCPICKQPVHRGPGDEDQEEETQGQEEGDEGEPRDHPASERTPLLGSSPTLPTSFGSLAPAPLVFPGPSTDPPLSPPSSPVILV

SEQ ID NO: 858060 - protein, 315 aa, Homo sapiens; identical to SEQ ID NO: 858055

SEQ ID NO: 858061 - protein, 145 aa, Homo sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSSSLQSSEG

SEQ ID NO: 858062 - protein, 186 aa, Homo sapiens
CLSLLALNSSMFCPDLILPTCLISSTGFVGEGKFLQGFKSLSPGSLWLSEGLDYFLSVPGDQYDVCAICLDEYEDGDKLRVLPCAHAYHSRCVDPWLTQTRKTCPICKQPVHRGPGDEDQEEETQGQEEGDEGEPRDHPASERTPLLGSSPTLPTSFGSLAPAPLVFPGPSTDPPLSPPSSPVILV

SEQ ID NO: 858063 - protein, 171 aa, Homo sapiens
CLSLLALNSSMFCPDLILPTCLISSTGFVGEGKFLQGFKSLSPGSLWLSEGLDYFLSVPGDQYDVCAICLDEYEDGDKLRVLPCAHAYHSRCVDPWLTQTRKTCPICKQPVHRGPGDEDQEEETQGQEEGDEGEPRDHPASERTPLLGSSPTPLPLPLLSWSNNPPHIHLW

SEQ ID NO: 858064 - protein, 350 aa, Homo sapiens [sequence omitted]

SEQ ID NO: 858065 - protein, 350 aa, Homo sapiens [sequence omitted]

SEQ ID NO: 858066 - protein, 319 aa, Homo sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGDQYDVCAICLDEYEDGDKLRVLPCAHGEALTACPCPSATSSHQVLHLVPLCSLPQPLRGPLAHSDPEDLPHLQAACSSGSWGRRPRGRNSRARGG

SEQ ID NO: 858067 - protein, 195 aa, Homo sapiens [sequence omitted]

SEQ ID NO: 858068 - protein, 319 aa, Homo sapiens; identical to SEQ ID NO: 858066

SEQ ID NO: 858069 - protein, 335 aa, Homo sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGDQYDVCAICLDEYEDGDKLRVLPCAHAYHSRCVDPWLTQTRKTCPICKQPVHRGPGDEDQEEETQGQEEGDEGEPRDHPASERTPLLGSSPTPLPLPLLSWSNNPPHIHLW

SEQ ID NO: 858070 - protein, 350 aa, Homo sapiens [sequence omitted]

SEQ ID NO: 858071 - protein, 350 aa, Homo sapiens [sequence omitted]

SEQ ID NO: 858072 - protein, 252 aa, Homo sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGDQYDVCAICPLPLPLLSWSNNPPHIHLW

SEQ ID NO: 858073 - protein, 350 aa, Homo sapiens [sequence omitted]

SEQ ID NO: 858074 - protein, 315 aa, Homo sapiens; identical to SEQ ID NO: 858055

SEQ ID NO: 858075 - protein, 243 aa, Homo sapiens; identical to SEQ ID NO: 858058

SEQ ID NO: 858076 - protein, 308 aa, Homo sapiens; identical to SEQ ID NO: 858059

SEQ ID NO: 858077 - protein, 211 aa, Homo sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRAIRDRA

SEQ ID NO: 858078 - protein, 202 aa, Homo sapiens
LDTGHPFPRARVLLVPDNTFPLGYYLIPFTGIVGLLVLAMGAVMIARCIQHRKRLQRNRLTKEQLKQIPTHDYQKGDQYDVCAICLDEYEDGDKLRVLPCAHAYHSRCVDPWLTQTRKTCPICKQPVHRGPGDEDQEEETQGQEEGDEGEPRDHPASERTPLLGSSPTLPTSFGSLAPAPLVFPGPSTDPPLSPPSSPVILV

SEQ ID NO: 858079 - protein, 126 aa, Homo sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNPKLLPYPHLSF

SEQ ID NO: 858080 - protein, 131 aa, Homo sapiens
MTIRRDQYDVCAICLDEYEDGDKLRVLPCAHAYHSRCVDPWLTQTRKTCPICKQPVHRGPGDEDQEEETQGQEEGDEGEPRDHPASERTPLLGSSPTLPTSFGSLAPAPLVFPGPSTDPPLSPPSSPVILV

SEQ ID NO: 858081 - protein, 371 aa, Homo sapiens
TSTIVPAPEKRADDWARGPPQRPLGPAKSQRGCSHFQAPHTKDRLDGKAETRGLGPQTGDSRRLGQGPGLPVTISFVDPGTASRRLPFSPPQRRRWRRRNSTRTDRPPAPAEAEAVARSGPGPWAPRAARVMRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCTVSVKDIQAHLAQGHVAIVLVNSGVLHCDLCSSPVKYCCFTPSGHHCFCRTPDYQGHFIVLRGYNRATGCIFYNNPAYADPGMCSTSISNFEEARTSYGTDEDILFVYLDS

SEQ ID NO: 858082 - protein, 240 aa, Homo sapiens
MRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCTVSVKDIQAHLAQGHVAIVLVNSGVLHCDLCSSPVKYCCFTPSGHHCFCRTPDYQGHFIVLRGYNRATGCIFYNNPAYADPGMCSTSISNFEEARTSYGTDEDILFVYLDS

SEQ ID NO: 858083 - protein, 293 aa, Homo sapiens
EIFPWCVPGIVEFRHGWGSSITHRYVSSLCPCLNSEAVARSGPGPWAPRAARVMRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCTVSVKDIQAHLAQGHVAIVLVNSGVLHCDLCSSPVKYCCFTPSGHHCFCRTPDYQGHFIVLRGYNRATGCIFYNNPAYADPGMCSTSISNFEEARTSYGTDEDILFVYLDS

SEQ ID NO: 858084 - protein, 296 aa, Homo sapiens
MTGPGGRRNDPWGRQRAREGAHTSKHPTPRTGWTARRRRGAWALRPGTAGGWAKGQDFPSQFHLLIPAPPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCTVSVKDIQAHLAQGHVAIVLVNSGVLHCDLCSSPVKYCCFTPSGHHCFCRTPDYQGHFIVLRGYNRATGCIFYNNPAYADPGMCSTSISNFEEARTSYGTDEDILFVYLDS

SEQ ID NO: 858085 - protein, 193 aa, Homo sapiens
MTGPGGRRNDPWGRQRAREGAHTSKHPTPRTGWTARRRRGAWALRPGTAGGWAKGQDFPSQFHLLIPAPPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCRNVQHQHQ

SEQ ID NO: 858086 - protein, 268 aa, Homo sapiens
TSTIVPAPEKRADDWARGPPQRPLGPAKSQRGCSHFQAPHTKDRLDGKAETRGLGPQTGDSRRLGQGPGLPVTISFVDPGTASRRLPFSPPQRRRWRRRNSTRTDRPPAPAEAEAVARSGPGPWAPRAARVMRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCRNVQHQHQ

SEQ ID NO: 858087 - protein, 371 aa, Homo sapiens; identical to SEQ ID NO: 858081

SEQ ID NO: 858088 - protein, 371 aa, Homo sapiens; identical to SEQ ID NO: 858081

SEQ ID NO: 858089 - protein, 371 aa, Homo sapiens; identical to SEQ ID NO: 858081

SEQ ID NO: 858090 - protein, 371 aa, Homo sapiens; identical to SEQ ID NO: 858081

SEQ ID NO: 858091 - protein, 371 aa, Homo sapiens; identical to SEQ ID NO: 858081

SEQ ID NO: 858092 - protein, 150 aa, Homo sapiens
HVAIVLVNSGVLHCDLCSSPVKYCCFTPSGHHCFCRTPDYQGHFIVLRGYNRATGCIFYNNPAYADRECWVGWVRQSGPHSLFCMPSAHSSHPFNLVWPGPPSLPFPQSPCSSWALVTVATPQAMQANLPQTVPASSTPWPPLPLTPQAP

SEQ ID NO: 858093 - protein, 328 aa, Homo sapiens
TSTIVPAPEKRADDWARGPPQRPLGPAKSQRGCSHFQAPHTKDRLDGKAETRGLGPQTGDSRRLGQGPGLPVTISFVDPGTASRRLPFSPPQRRRWRRRNSTRTDRPPAPAEAEAVARSGPGPWAPRAARVMRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCGHHCFCRTPDYQGHFIVLRGYNRATGCIFYNNPAYADPGMCSTSISNFEEARTSYGTDEDILFVYLDS

SEQ ID NO: 858094 - protein, 371 aa, Homo sapiens; identical to SEQ ID NO: 858081

SEQ ID NO: 858095 - protein, 167 aa, Homo sapiens
EIFPWCVPGIVEFRHGWGSSITHRYVSSLCPCLNSEAVARSGPGPWAPRAARVMRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQVSDQPPGLPMWGHTEV

SEQ ID NO: 858096 - protein, 107 aa, Homo sapiens
DLQRITLPSINRLRHFTNDTILDVFFYNSPTYCQTIVDTVASEMNRIYTLFLQRNPDFKGGVSIAGHSLGLLNIVMDQGDTPTLEEDLKKLQLSEFFDIFEKEKVDK

SEQ ID NO: 858097 - protein, 711 aa, Homo sapiens
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKLMVHYQPVAGSDDWGSTPTEQGRPRTVKRGVENISVDIHCGEPLQIDHLVFVVHGIGPACDLRFRSIVQCVNDFRSVSLNLLQTHFKKAQENQQIGRVEFLPVNWHSPLHSTGVDVDLQRITLPSINRLRHFTNDTILDVFFYNSPTYCQTIVDTVASEMNRIYTLFLQRNPDFKGGVSIAGHSLGSLILFDILTNQKDSLGDIDSEKDSLNIVMDQGDTPTLEEDLKKLQLSEFFDIFEKEKVDKEALALCTDRDLQEIGIPLGPRKKILNYFSTRKNSMGIKRPAPQPASGANIPKESEFCSSSNTRNGDYLDVGIGQVSVKYPRLIYKPEIFFAFGSPIGMFLTVRGLKRIDPNYRFPTCKGFFNIYHPFDPVAYRIEPMVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 858098 - protein, 615 aa, Homo sapiens [sequence omitted]

SEQ ID NO: 858099 - protein, 201 aa, Homo sapiens [sequence omitted]

SEQ ID NO: 858100 - protein, 130 aa, Homo sapiens
MSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 858101 - protein, 122 aa, Homo sapiens
DTCHFLGSKLRVLMVLLSKSYCGNSYDFNYQPPILRFKLLSLLDVKLQSLCIRLWHSLWLPSSCDCSSSPTFFPRRTLRDPSPENPPVCCCNFPLLSCVISCMLPATYSPLGSLEDNLPLWK

SEQ ID NO: 858102 - protein, 711 aa, Homo sapiens; identical to SEQ ID NO: 858097

SEQ ID NO: 858103 - protein, 675 aa, Homo sapiens
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKLMVHYQPVAGSDDWGSTPTEQGRPRTVKRGVENISVDIHCGEPLQIDHLVFVVHGIGPACDLRFRSIVQCVNDFRSVSLNLLQTHFKKAQENQQIGRVEFLPVNWHSPLHSTGVDVDLQRITLPSINRLRHFTNDTILDVFFYNSPTYCQTIVDTVASEMNRIYTLFLQRNPDFKGGVSIAGHSLGSLILFDILTNQKDSLGDIDSEKDSLNIVMDQGDTPTLEEDLKKLQLSEFFDIFEKEKVDKEALALCTDRDLQEIGIPLGPRKKILNYFSTRKNSMGIKRPAPQPASGANIPKESEFCSSSNTRNGDYLDVGIGQVSVKYPRLIYKPEIFFAFGSPIGMFLTVRGLKRIDPNYRFPTCKGFFNIYHPFDPVAYRIEPMVVPGVEFEPMLIPHHKGRKRMHLELREGLTRMSMDLKNNLLGSLRMAWKSFTRAPYPALQASETPEETEAEPESTSEKPSAIESFNEYLFALQSHLCYWESEDTVLLVLKEIYQTQGIFLDQPLQ

SEQ ID NO: 858104 - protein, 227 aa, Homo sapiens
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKLMVHYQPVAGSDDWGSTPTEQGRPRTVKRGVENISVDIHCGNVNRLFFLTFGCICLLLKL

SEQ ID NO: 858105 - protein, 179 aa, Homo sapiens
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKVKQSISLVGIKS

SEQ ID NO: 858106 - protein, 173 aa, Homo sapiens
RTRGSTHASEPMVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 858107 - protein, 724 aa, Homo sapiens
RGRAPRSPPPESEMSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKLMVHYQPVAGSDDWGSTPTEQGRPRTVKRGVENISVDIHCGEPLQIDHLVFVVHGIGPACDLRFRSIVQCVNDFRSVSLNLLQTHFKKAQENQQIGRVEFLPVNWHSPLHSTGVDVDLQRITLPSINRLRHFTNDTILDVFFYNSPTYCQTIVDTVASEMNRIYTLFLQRNPDFKGGVSIAGHSLGSLILFDILTNQKDSLGDIDSEKDSLNIVMDQGDTPTLEEDLKKLQLSEFFDIFEKEKVDKEALALCTDRDLQEIGIPLGPRKKILNYFSTRKNSMGIKRPAPQPASGANIPKESEFCSSSNTRNGDYLDVGIGQVSVKYPRLIYKPEIFFAFGSPIGMFLTVRGLKRIDPNYRFPTCKGFFNIYHPFDPVAYRIEPMVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 858108 - protein, 704 aa, Homo sapiens
MFSNILCKWQKGAGSSPPASITFLAFTYVLDLYRKSQILNDFPNSASSIDEARSFLRIKIRVGTCYNKNENKTHLTPVSLPDVDIKEVNHCLWLLQPSRNEEPSTLPFSASHRQLFSFFPRSSGGPAPPSPAQCLRKFPRISSLALTDPVSEALADYQKSYVHFFLQQINMWLKKIPPLAHAALSYFIVGQELKTSHLHSDHIIDLKVNKYQLQTMSEQCLLEYFIGVSQAQCMYTHAHIKDNFLFCIYNLQLKNISNRSTLTLWRCEENSLAPAGLKPLFRPLKNIHGQRLQNYGYLFFLRWSLALSPRLECSDVILAHCNLCLLRNWDYRYVPPCPAPFCIFSRDRVSPCWSGWSQTPDLMICPPRPPKVLGLQVEPLHLAAILFSTLISEMVKNPINHNFFLISAELCYRYENKMWHNEEGCIKILKPKVSVVYRMYPGFHRKVFEIVNSTKSKSKEIRFHVGYCFKNCIWNIKGNPYVSKFKKPNIIYKIKFYMIKPSFSYFLKGHQLYNCSRAKFSVLVSCISCYLEQLYLVTWIAFSILLFLLGPYLINRSTGSPMSHRRINCWSQANGSLGASVKELQCFLQEKIQYNCTFTYKKKRHKTDFHPLSIEELYIDKQMEHSIQLKECGESIYPPYLHKVTRYLRENKCYQVPAIVSSQNSQRKLTFIQANPRLLLSTVLQQCLTLLIIFIQGILEYTYS

SEQ ID NO: 858109 - protein, 232 aa, Homo sapiens [sequence omitted]

SEQ ID NO: 858110 - protein, 711 aa, Homo sapiens; identical to SEQ ID NO: 858097

SEQ ID NO: 858111 - protein, 711 aa, Homo sapiens; identical to SEQ ID NO: 858097

SEQ ID NO: 858112 - protein, 451 aa, Homo sapiens
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKLMVHYQPVAGSDDWGSTPTEQGRPRTVKRGVENISVDIHCGEPLQIDHLVFVVHGIGPACDLRFRSIVQCVNDFRSVSLNLLQTHFKKAQENQQIGRVEFLPVNWHSPLHSTGVDVDLQRITLPSINRLRHFTNDTILDVFFYNSPTYCQTIVDTVASEMNRIYTLFLQRNPDFKGGVSIAGHSLGSLILFDILTNQKDSLGDIDSEKDSLNIVMDQGDTPTLEEDLKKLQLSEFFDIFEKEKVDKEALALCTDRDLQEIGIPLGPRKKILNYFSTRKNSMVCA

SEQ ID NO: 858113 - protein, 316 aa, Homo sapiens
MSGDTCLCPASGAKPKLSGFKGGGLGNKYVQLNVGGSLYYTTVRALTRHDTMLKAMFSGRMEVLTDKEGWILIDRCGKHFGTILNYLRDDTITLPQNRQEIKELMAEAKYYLIQGLVNMCQSALQDKKDSYQPVCNIPIITSLKEEERLIESSTKPVVKLLYNRSNNKYSYTSNSDDHLLKNIELFDKLSLRFNGRVLFIKDVIGDEICCWSFYGQGRKLAEVCCTSIVYATEKKQTKVEFPEARIYEETLNVLLYETPRVPDNSLLEATSRSRSQASPSEDEETFELRDRVRRIHVKRYSTYDDRQLGHQSTHRD

SEQ ID NO: 858114 - protein, 93 aa, Homo sapiens
SGRSRSRTREKKQTKVEFPEARIYEETLNVLLYETPRVPDNSLLEATSRSRSQASPSEDEETFELRDRVRRIHVKRYSTYDDRQLGHQSTHRD

SEQ ID NO: 858115 - protein, 316 aa, Homo sapiens; identical to SEQ ID NO: 858113

SEQ ID NO: 858116 - protein, 93 aa, Homo sapiens; identical to SEQ ID NO: 858114

SEQ ID NO: 858117 - protein, 316 aa, Homo sapiens; identical to SEQ ID NO: 858113

SEQ ID NO: 858118 - protein, 203 aa, Homo sapiens
MSGDTCLCPASGAKPKLSGFKGGGLGNKYVQLNVGGSLYYTTVRALTRHDTMLKAMFSGRMEVLTDKEGWILIDRCGKHFGTILNYLRDDTITLPQNRQEIKELMAEAKYYLIQGLVNMCQSALQDKKDSYQPVCNIPIITSLKEEERLIESSTKPVVKLLYNRSNNKYSYTSNSDDHLLKNIELVTGTVKINDWLLSIKKKK

SEQ ID NO: 858119 - protein, 126 aa, Homo sapiens
MSGDTCLCPASGAKPKLSGFKGGGLGNKYVQLNVGGSLYYTTVRALTRHDTMLKAMFSGRMEVLTDKEGWILIDRCGKHFGTILNYLRDDTITLPQNRQEIKELMAEAKYYQLLAVCIFQLQAAQG

SEQ ID NO: 858120 - protein, 316 aa, Homo sapiens; identical to SEQ ID NO: 858113

SEQ ID NO: 858121 - protein, 316 aa, Homo sapiens; identical to SEQ ID NO: 858113

SEQ ID NO: 858122 - protein, 83 aa, Homo sapiens
KGYGQVARPGFNRPRQIMSHGRKTVEPVGTAWCWLACPSAEDSKLPAAPTEVAHAWPHIYSLPTPSMLLVGAGWDGGSAQWCL

SEQ ID NO: 858123 - protein, 189 aa, Homo sapiens
MSGDTCLCPASGAKPKLSGFKGGGLGNKYVQLNVGGSLYYTTVRALTRHDTMLKAMFSGRMEVLTDKEGWILIDRCGKHFGTILNYLRDDTITLPQNRQEIKELMAEAKYYLIQGLVNMCQSALQDKKDSYQPVCNIPIITSLKEEERLIESSTKPVVKLLYNRSNNKYSYTSNSWLCAFFNSKQPRGK

SEQ ID NO: 858124 - protein, 550 aa, Homo sapiens
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRYSVPQAELQGRVLSLSVWHRESLGRNIFLGEVEVPLDTWDWGSEPTWLPLQPRVPPSPDDLPSRGLLALSLKYVPAGSEGAGLPPSGELHFWVKEARDLLPLRAGSLDTYVQCFVLPDDSRASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 858125 - protein, 543 aa, Homo sapiens [sequence omitted]

SEQ ID NO: 858126 - protein, 590 aa, Homo sapiens
MPLSAGQMLSFRSHCGSSVCPAGAQPQLMPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRYSVPQAELQGRVLSLSVWHRESLGRNIFLGEVEVPLDTWDWGSEPTWLPLQPRVPPSPDDLPSRGLLALSLKYVPAGSEGAGLPPSGELHFWVKEARDLLPLRAGSLDTYVQCFVLPDDSRASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 858127 - protein, 663 aa, Homo sapiens
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRYSVPQAELQGRVLSLSVWHRESLGRNIFLGEVEVPLDTWDWGSEPTWLPLQPRVRQPGRVGRPAARVSCIYPTRLSRSPLTPRLRQTSPQPLNLMAPGEARPATAPSPRALGPLGSAPAGPAVSSSRTPSGSADPTLLRPLSISPCSTISRLSQVPPSPDDLPSRGLLALSLKYVPAGSEGAGLPPSGELHFWVKEARDLLPLRAGSLDTYVQCFVLPDDSRASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 858128 - protein, 423 aa, Homo sapiens
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPECPAGQAGRGCHSPAHHSQGLGLLVLIFKMGTTALLGGVRLSETIPVKRLARGLARVRDGGWGSPQAGEKALGGPLLTSGSHLPSYVKSYLLPDKQSKRKTAVKKRNLNPVFNETLRVRL

SEQ ID NO: 858129 - protein, 647 aa, Homo sapiens
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPECPAGQAGRGCHSPAHHSQGLGLLVLIFKMGTTALLGGVRLSETIPVKRLARGLARVRDGGWGSPQAGEKALGGPLLTSGSHLPSYVKSYLLPDKQSKRKTAVKKRNLNPVFNETLRYSVPQAELQGRVLSLSVWHRESLGRNIFLGEVEVPLDTWDWGSEPTWLPLQPRVPPSPDDLPSRGLLALSLKYVPAGSEGAGLPPSGELHFWVKEARDLLPLRAGSLDTYVQCFVLPDDSRASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 858130 - protein, 234 aa, Homo sapiens
MAPGEARPATAPSPRALGPLGSAPAGPAVSSSRTPSGSADPTLLRPLSISPCSTISPPLQVPPSPDDLPSRGLLALSLKYVPAGSEGAGLPPSGELHFWVKEARDLLPLRAGSLDTYVQCFVLPDDSRASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 858131 - protein, 225 aa, Homo sapiens
DDTLFVRFDIDATSPRKDPRAPWIEQEGPEYWDRETQISKSNTQTYRAHSPVPPSPDDLPSRGLLALSLKYVPAGSEGAGLPPSGELHFWVKEARDLLPLRAGSLDTYVQCFVLPDDSRASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 858132 - protein, 543 aa, Homo sapiens [sequence omitted]

SEQ ID NO: 858133 - protein, 286 aa, Homo sapiens
MQAGTGPEVLGSAARGAGATCEGVLPYWTPTGSSVCPAGAQPQLMPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQVGGSGPWLLSTSGADSGRGALLPRAASRPRP

SEQ ID NO: 858134 - protein, 606 aa, Homo sapiens
MQAGTGPEVLGSAARGAGATCEGVLPYWTPTGSSVCPAGAQPQLMPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRYSVPQAELQGRVLSLSVWHRESLGRNIFLGEVEVPLDTWDWGSEPTWLPLQPRVPPSPDDLPSRGLLALSLKYVPAGSEGAGLPPSGELHFWVKEARDLLPLRAGSLDTYVQCFVLPDDSRASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 858135 - protein, 765 aa, Homo sapiens
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRVRLRPRCGSPLMNWTPPSCGARWQGQPVTSLPGGSAEGPINSLSSVVSLVVGVVIVQVPINALRGSPEFHHGRNAVGPASANSRSIYAGHQQCSTKLTSCPQYSVPQAELQGRVLSLSVWHRESLGRNIFLGEVEVPLDTWDWGSEPTWLPLQPRVRQPGRVGRPAARVSCIYPTRLSRSPLHPAFDRTSPQPLNLMAPGEARPATAPSPRALGPLGSAPAGPAVSSSRTPSGSADPTLLRPLSISPCSTISRLSQVPPSPDDLPSRGLLALSLKYVPAGSEGAGLPPSGELHFWVKEARDLLPLRAGSLDTYVQCFVLPDDSRASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 858136 - protein, 509 aa, Homo sapiens
MPQRGHPSQEGLWALPSLPMAHGPKPETEGLLDLSFLTEEEQEAIAGVLQRDARLRQLEEGRVSKLRASVADPGQLKILTGDWFQEARSQRHHNAHFGSDLVRASMRRKKSTRGDQAPGHDREAEAAVKEKEEGPEPRLTIDEAPQERLRETEGPDFPSPSVPLKASDPEEASQAQEDPGQGDQQVCAEEADPELEPASGGEQEPRPQQAQTKAASQILENGEEAPGPDPSLDRMLSSSSSVSSLNSSTLSGSQMSLSGDAEAVQVRGSVHFALHYEPGAAELRVHVIQCQGLAAARRRRSDPYVKSYLLPDKQSKRKTAVKKRNLNPVFNETLRVPPSPDDLPSRGLLALSLKYVPAGSEGAGLPPSGELHFWVKEARDLLPLRAGSLDTYVQCFVLPDDSRASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 858137 - protein, 234 aa, Homo sapiens
MAPGEARPATAPSPRALGPLGSAPAGPAVSSSRTPSGSADPTLLRPLSISPCSTISRLSQVPPSPDDLPSRGLLALSLKYVPAGSEGAGLPPSGELHFWVKEARDLLPLRAGSLDTYVQCFVLPDDSRASRQRTRVVRRSLSPVFNHTMVYDGFGPADLRQACAELSLWDHGALANRQLGGTRLSLGTGSSYGLQVPWMDSTPEEKQLWQALLEQPCEWVDGLLPLRTNLAPRT

SEQ ID NO: 858138 - protein, 64 aa, Homo sapiens
MPGHLPHSFVLPDDSRASRQRTRVVRRSLSPVFNHTMVYDGFGPADLRQACAELSLWDHGALAN

SEQ ID NO: 858139 - protein, 778 aa, Homo sapiens
PEKKAVPGRPAEGPGAGLVTLPGQPITPGFISGPALLPHISPPLVHFARRSGWEHRHFRSWSRHCRRHFVSVEKEASVAAGSGRRSPARRRRFIPEVPPVSSPIPPPRSACGEAGAAREPGRGRGVGREAGYPERLQLQLQRTSEGGRGAMSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHQGELVKH

SEQ ID NO: 858140 - protein, 1705 aa, Homo sapiens
PEKKAVPGRPAEGPGAGLVTLPGQPITPGFISGPALLPHISPPLVHFARRSGWEHRHFRSWSRHCRRHFVSVEKEASVAAGSGRRSPARRRRFIPEVPPVSSPIPPPRSACGEAGAAREPGRGRGVGREAGYPERLQLQLQRTSEGGRGAMSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFPLKRPRYEDSDKPFVDSPASRFAGLDTNQRLTALAEDRPLFDGPSRPSVARDGPTKMIFEGPNKLSPRIDGPPTPASLRFDGSPGQMGGGGPLRFEGPQGQLGGGCPLRFEGPPGPVGTPLRFEGPIGQAGGGGFRFEGSPGLRFEGSPGGLRFEGPGGQPVGGLRFEGHRGQPVGGLRFEGPHGQPVGGLRFDNPRGQPVGGLRFEGGHGPSGAAIRFDGPHGQPGGGIRFEGPLLQQGVGMRFEGPHGQSVAGLRFEGQHNQLGGNLRFEGPHGQPGVGIRFEGPLVQQGGGMRFEGPSVPGGGLRIEGPLGQGGPRFEGCHALRFDGQPGQPSLLPRFDGLHGQPGPRFERTPGQPGPQRFDGPPGQQVQPRFDGVPQRFDGPQHQQASRFDIPLGLQGTRFDNHPSQRLESVSFNQTGPYNDPPGNAFNAPSQGLQFQRHEQIFDSPQGPNFNGPHGPGNQSFSNPLNRASGHYFDEKNLQSSQFGNFGNIPAPMTVGNIQASQQVLSGVAQPVAFGQGQQFLPVHPQNPGFVQNPSGALPKAYPDNHLSQVDVNELFSKLLKTGILKLSQTDSATTQVSEVTAQPPPEEEEDQNEDQDVPDLTNFTVEELKQRYDSVINRLYTGIQCYSCGMRFTTSQTDVYADHLDWHYRQNRTEKDVSRKVTHRRWYYSLTDWIEFEEIADLEERAKSQFFEKVHEEVVLKTQEAAKEKEFQSVPAGPAGAVESCEICQEQFEQYWDEEEEEWHLKNAIRVDGKIYHPSCYEDYQNTSSFDCTPSPSKTPVENPLNIMLNIVKNELQEPCDSPKVKEERIDTPPACTEESIATPSEIKTENDTVESV

SEQ ID NO: 858141 - protein, 1705 aa, Homo sapiens; identical to SEQ ID NO: 858140

SEQ ID NO: 858142 - protein, 1705 aa, Homo sapiens; identical to SEQ ID NO: 858140

SEQ ID NO: 858143 - protein, 225 aa, Homo sapiens
PEKKAVPGRPAEGPGAGLVTLPGQPITPGFISGPALLPHISPPLVHFARRSGWEHRHFRSWSRHCRRHFVSVEKEASVAAGSGRRSPARRRRFIPEVPPVSSPIPPPRSACGEAGAAREPGRGRGVGREAGYPERLQLQLQRTSEGGRGAMSEQTPAEAGAAGAREDACRDYQSSLEDLTFNSKPHINMLTILAEENLPFAKEIVSLIEAQTAKVFIHPAASYYF

SEQ ID NO: 858144 - protein, 1705 aa, Homo sapiens; identical to SEQ ID NO: 858140

SEQ ID NO: 858145 - protein, 214 aa, Homo sapiens
PEKKAVPGRPAEGPGAGLVTLPGQPITPGFISGPALLPHISPPLVHFARRSGWEHRHFRSWSRHCRRHFVSVEKEASVAAGSGRRSPARRRRFIPEVPPVSSPIPPPRSACGEAGAAREPGRGRGVGREAGYPERLQLQLQRTSEGGRGAMSEQTPAEAGAAGAREDACRDYQSSLEDLTFNSKPHINMLTILAEECFSLPLDRSGPLPPYISL

SEQ ID NO: 858146 - protein, 1705 aa, Homo sapiens; identical to SEQ ID NO: 858140

SEQ ID NO: 858147 - protein, 987 aa, Homo sapiens
HRCNVRDSPTEENKGGLKKKPLLSDAELTYYEHKAKLKRTQVQHSFPRLDLLDPDIFDYPLTDALLSGIECEPSKSKHASRNSGAQFDRKEQFSERARRLSPISGSRTYAENLSPHEGRRRHDEQVSAKGVREEQRSPFNDRFPLKRPRYEDSDKPFVDSPASRFAGLDTNQRLTALAEDRPLFDGPSRPSVARDGPTKMIFEGPNKLSPRIDGPPTPASLRFDGSPGQMGGGGPLRFEGPQGQLGGGCPLRFEGPPGPVGTPLRFEGPIGQAGGGGFRFEGSPGLRFEGSPGGLRFEGPGGQPVGGLRFEGHRGQPVGGLRFEGPHGQPVGGLRFDNPRGQPVGGLRFEGGHGPSGAAIRFDGPHGQPGGGIRFEGPLLQQGVGMRFEGPHGQSVAGLRFEGQHNQLGGNLRFEGPHGQPGVGIRFEGPLVQQGGGMRFEGPSVPGGGLRIEGPLGQGGPRFEGCHALRFDGQPGQPSLLPRFDGLHGQPGPRFERTPGQPGPQRFDGPPGQQVQPRFDGVPQRFDGPQHQQASRFDIPLGLQGTRFDNHPSQRLESVSFNQTGPYNDPPGNAFNAPSQGLQFQRHEQIFDSPQGPNFNGPHGPGNQSFSNPLNRASGHYFDEKNLQSSQFGNFGNIPAPMTVGNIQASQQVLSGVAQPVAFGQGQQFLPVHPQNPGFVQNPSGALPKAYPDNHLSQVDVNELFSKLLKTGILKLSQTDSATTQVSEVTAQPPPEEEEDQNEDQDVPDLTNFTVEELKQRYDSVINRLYTGIQCYSCGMRFTTSQTDVYADHLDWHYRQNRTEKDVSRKVTHRRWYYSLTDWIEFEEIADLEERAKSQFFEKVHEEVVLKTQEAAKEKEFQSVPAGPAGAVESCEICQEQFEQYWDEEEEEWHLKNAIRVDGKIYHPSCYEDYQNTSSFDCTPSPSKTPVENPLNIMLNIVKNELQEPCDSPKVKEERIDTPPACTEESIATPSEIKTENDTVESV

SEQ ID NO: 858148 - protein, 225 aa, Homo sapiens; identical to SEQ ID NO: 858143

SEQ ID NO: 858149 - protein, 610 aa, Homo sapiens
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTGERPFICELCGNSYTDIKNLKKHKTKVHSGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 858150 - protein, 337 aa, Homo sapiens [sequence omitted]

SEQ ID NO: 858151 - protein, 582 aa, Homo sapiens
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGERPFICELCGNSYTDIKNLKKHKTKVHSGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 858152 - protein, 636 aa, Homo sapiens
LGYRGRCDVSPLGCYRSRVKFHSDIKMQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTGERPFICELCGNSYTDIKNLKKHKTKVHSGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 858153 - protein, 337 aa, Homo sapiens [sequence omitted]

SEQ ID NO: 858154 - protein, 610 aa, Homo sapiens; identical to SEQ ID NO: 858149

SEQ ID NO: 858155 - protein, 234 aa, Homo sapiens
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKKKKKKKEMMLEGAMAPHEKRFSETHMSGEQRGGPSERRGNNVTLGGKPPRGESRGREIHGGVGEIYDTNEKREAAGGEPRTGVWEKQFRERRTSAESTTTGGILSTGGVPRGRARRYQIE

SEQ ID NO: 858156 - protein, 496 aa, Homo sapiens
MEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTGERPFICELCGNSYTDIKNLKKHKTKVHSGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 858157 - protein, 327 aa, Homo sapiens
MKPNFSLRLRIFNLNCWGIPYLSKHRADRMRRLGDFLNQESFDLALLEEVWSEQDFQYLRQKLSPTYPAAHHFRSGIIGSGLCVFSKHPIQELTQHIYTLNGYPYMIHHGDWFSGKAVGLLVLHLSGMVLNAYVTHLHAEYNRQKDIYLAHRVAQAWELAQFIHHTSKKADVVLLCGDLNMHPEDLGCCLLKEWTGLHDAYLETRDFKGSEEGNTMVPKNCYVSQQELKPFPFGVRIDYVLYKAVSGFYISCKSFETTTGFDPHSGTPLSDHEALMATLFCEAQPPTAEPQLYPRTSREVAVDVCAKGGLDGAGSGHGSGSLVGHLR

SEQ ID NO: 858158 - protein, 465 aa, Homo sapiens [sequence omitted]

SEQ ID NO: 858159 - protein, 546 aa, Homo sapiens
MKPNFSLRLRIFNLNCWGIPYLSKHRADRMRRLGDFLNQESFDLALLEEVWSEQDFQYLRQKLSPTYPAAHHFRSGIIGSGLCVFSKHPIQELTQHIYTLNGYPYMIHHGDWFSGKAVGLLVLHLSGMVLNAYVTHVVKLAVPRAGTCSPVLGQRDGTSLALIPGDEVWGQDLIRKQWARLIHCIPNTMPSDRHRLDSDITPGTLSLICCDLIYLAQLHAEYNRQKDIYLAHRVAQAWELAQFIQCVSLGLKWEVGWDPGAEGEQGPSHGEELVMEELPPHQPGSPSHTSKKADVVLLCGDLNMHPEDLGCCLLKEWTGLHDAYLETRDFKGSEEGNTMVPKNCYVSQQELKPFPFGVRIDYVLYKAVSGFYISCKSFETTTGFDPHSGTPLSDHEALMATLFVRHSPPQQNPSSTHGPAERSPLMCVLKEAWTELGLGMAQARWWATFASYVIGLGLLLLALLCVLAAGGGAGEAAILLWTPSVGLVLWAGAFYLFHVQEVNGLYRAQAELQHVLGRAREAQDLGPEPQPALLLGQQEGDRTKEQ

SEQ ID NO: 858160 - protein, 423 aa, Homo sapiens [sequence omitted]

SEQ ID NO: 858161 - protein, 138 aa, Homo sapiens
MCHSRSCHPTMTILQAPTPAPSTIPGPRRGSGPEIFTFDPLPEPAAAPAGRPSASRGHRKRSRRVLYPRVVSIAEVGIRGVRCPGVTGERPDSRGLDLTCLLFCLPLGPAPAASRGTEPSQKASLSAAHHRLLPDPDG

SEQ ID NO: 858162 - protein, 117 aa, Homo sapiens
RGTKEARGTKEGPSASRGHRKRSRRVLYPRVVRRQLPVEEPNPAKRLLFLLLTIVFCQILMAEEGVPAPLPPEDAPNAASLAPTPVSPVLEPFNLTSEPSDYALDLSTFLQQHPAAF

SEQ ID NO: 858163 - protein, 120 aa, Homo sapiens
MCHSRSCHPTMTILQAPTPAPSTIPGPRRGSGPEIFTFDPLPEPAAAPAGRPSASRGHRKRSRRVLYPRVVRRQLPVEEPNPAKRLLFLLLTIVFCLQRTPLTPHPWRPPLCPPSSSPLI

SEQ ID NO: 858164 - protein, 156 aa, Homo sapiens
MCHSRSCHPTMTILQAPTPAPSTIPGPRRGSGPEIFTFDPLPEPAAAPAGRPSASRGHRKRSRRVLYPRVVRRQLPVEEPNPAKRLLFLLLTIVFCQILMAEEGVPAPLPPEDAPNAASLAPTPVSPVLEPFNLTSEPSDYALDLSTFLQQHPAAF

SEQ ID NO: 858165 - protein, 156 aa, Homo sapiens; identical to SEQ ID NO: 858164

SEQ ID NO: 858166 - protein, 156 aa, Homo sapiens; identical to SEQ ID NO: 858164

SEQ ID NO: 858167 - protein, 123 aa, Homo sapiens
MCHSRSCHPTMTILQAPTPAPSTIPGPRRGSGPEIFTFDPLPEPAAAPAGRPSASRGHRKRSRRVLYPRVVRRQLPVEEPNPAKRLLFLLLTIVFCQILMAEEGVPAPLPPEDAPNAASLAAR

SEQ ID NO: 858168 - protein, 156 aa, Homo sapiens; identical to SEQ ID NO: 858164

SEQ ID NO: 858169 - protein, 156 aa, Homo sapiens; identical to SEQ ID NO: 858164

SEQ ID NO: 858170 - protein, 156 aa, Homo sapiens; identical to SEQ ID NO: 858164

SEQ ID NO: 858171 - protein, 156 aa, Homo sapiens; identical to SEQ ID NO: 858164

SEQ ID NO: 858172 - protein, 156 aa, Homo sapiens; identical to SEQ ID NO: 858164

SEQ ID NO: 858173 - protein, 87 aa, Homo sapiens
LSCRTMCYRGAFVLGCSVVLSILEKRPLRMGMRLPLLRARCIPSRYRGLHRPKVEPPRRRWTAGRRTQGETQKEAHQRPVDIKDIPF

SEQ ID NO: 858174 - protein, 750 aa, Homo sapiens
SGPGLYGRRRSLEVATSLPHPSPGPRPAADVKMSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHAMAYQLQLQAASNFKSPVKTIRCFPPPPVLQSLTFPFFFATLSGTLYGFEFKLKESLLWWEYEDKVEEKAMKKKKKKKKKVCVLDALVVGIGYRKGISAPRKGHPPRDSYYPVSGDPGISRARFAFTKPKEVTGGAPAQDLRMLCPEDGIAEQQQCRIRSGDPSEGLPRRGAGLRRSEEEEEEDEDVDLAQVLAYLLRRGQVRLVQGGGAANLQFIQALLDSEEENDRAWDGRLGDRYNPPVDATPDTRAPDSWSCERRGLRSRTNQGLAMKPGFSPRGGGFGGRGGFGDRGGRGGRGGFGGGRGRGGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDPDPDCGPECPHLPA

SEQ ID NO: 858175 - protein, 80 aa, Homo sapiens
RTRGSTHADGLVYAVEFSHRSGRDLINLAKKRTNIIPVIEDARHPHKYRMLIAMVDVIFADVAQPDPDPDCGPECPHLPA

SEQ ID NO: 858176 - protein, 255 aa, Homo sapiens
MKPGFSPRGGGFGGRGGFGDRGGRGGRGGFGGGRGRGGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDPDPDCGPECPHLPA

SEQ ID NO: 858177 - protein, 255 aa, Homo sapiens; identical to SEQ ID NO: 858176

SEQ ID NO: 858178 - protein, 255 aa, Homo sapiens; identical to SEQ ID NO: 858176

SEQ ID NO: 858179 - protein, 255 aa, Homo sapiens; identical to SEQ ID NO: 858176

SEQ ID NO: 858180 - protein, 255 aa, Homo sapiens; identical to SEQ ID NO: 858176

SEQ ID NO: 858181 - protein, 255 aa, Homo sapiens; identical to SEQ ID NO: 858176

SEQ ID NO: 858182 - protein, 231 aa, Homo sapiens
MKPGFSPRGGGFGGRGGFGDRGGRGGRGGFGGGRGRGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDPDPDCGPECPHLPA

SEQ ID NO: 858183 - protein, 243 aa, Homo sapiens
MKPGFSPRGGGFGGRGGFGDRGGRGGRGGFGGGRGRGGGFRGRGRGGGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDPDPDCGPECPHLPA

SEQ ID NO: 858184 - protein, 219 aa, Homo sapiens
MKPGFSPRGGGFGGRGGFGDRGGRGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDPDPDCGPECPHLPA

SEQ ID NO: 858185 - protein, 194 aa, Homo sapiens
MKPGFSPRGGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDPDPDCGPECPHLPA

SEQ ID NO: 858186 - protein, 255 aa, Homo sapiens; identical to SEQ ID NO: 858176

SEQ ID NO: 858187 - protein, 169 aa, Homo sapiens
MVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDPDPDCGPECPHLPA

SEQ ID NO: 858188 - protein, 255 aa, Homo sapiens; identical to SEQ ID NO: 858176

SEQ ID NO: 858189 - protein, 255 aa, Homo sapiens; identical to SEQ ID NO: 858176

SEQ ID NO: 858190 - protein, 255 aa, Homo sapiens; identical to SEQ ID NO: 858176

SEQ ID NO: 858191 - protein, 264 aa, Homo sapiens
MKPGFSPRGGGFGGRGGFGDRGGRGGRGGFGGGRGRGGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDPEATVAVPAQQQEFSREQQEFSR

SEQ ID NO: 858192 - protein, 241 aa, Homo sapiens
MKPGFSPRGGGFGGRGGFGDRGGRGGRGGFGGGRGRGGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDVEPKITVVTLGCDFALAATDRFWSM

SEQ ID NO: 858193 - protein, 126 aa, Homo sapiens
MKPGFSPRGGGFGGRGEALEVVDEEEVEAAAAVEEEEEVVEASILVATGVVVGEEKEETSREFSHRSGRDLINLAKKRTNIIPVIEDARHPHKYRMLIAMVDVIFADVAQPDPDPDCGPECPHLPA

SEQ ID NO: 858194 - protein, 243 aa, Homo sapiens; identical to SEQ ID NO: 858183

SEQ ID NO: 858195 - protein, 164 aa, Homo sapiens
MKPGFSPRGGGFGGRGGFGDRGGRGGRGGFGGGRGRGGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGVGVGHKIPFKTLGG

SEQ ID NO: 858196 - protein, 229 aa, Homo sapiens
MAFLMLTEGKIGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDPDPDCGPECPHLPA

SEQ ID NO: 858197 - protein, 255 aa, Homo sapiens; identical to SEQ ID NO: 858176

SEQ ID NO: 858198 - protein, 255 aa, Homo sapiens; identical to SEQ ID NO: 858176

SEQ ID NO: 858199 - protein, 255 aa, Homo sapiens; identical to SEQ ID NO: 858176

SEQ ID NO: 858200 - protein, 255 aa, Homo sapiens; identical to SEQ ID NO: 858176

SEQ ID NO: 858201 - protein, 213 aa, Homo sapiens
MKPGFSPRGGGFGGRGGFGDRGGRGGRGGFGGGRGRGGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTLCDFH

SEQ ID NO: 858202 - protein, 187 aa, Homo sapiens
MSEMAELSELYEESSDLQMDVMPGEGDLPQMEVGSGSRELSLRPSRSGAQQLEEEGPMEEEEAQPMAAPEGKRSLANGPNAGEQPGQVAGADFESEDEGEEFDDWEDDYDYPEEEQLSGAGYRVSAALEEADKMFLRTREPALDGGFQMHYEKTPFDQLAFIEELFSLMVVNRLTEELGCDEIIDRE

SEQ ID NO: 858203 - protein, 187 aa, Homo sapiens; identical to SEQ ID NO: 858202

SEQ ID NO: 858204 - protein, 187 aa, Homo sapiens; identical to SEQ ID NO: 858202

SEQ ID NO: 858205 - protein, 187 aa, Homo sapiens; identical to SEQ ID NO: 858202

SEQ ID NO: 858206 - protein, 144 aa, Homo sapiens
MSEMAELSELYEESSDLQMDVMPGEGDLPQMEVGSGSRELSLRPSRSGAQQLEEEGPMEEEEAQPMAAPEGKRSLANGPNAGEQPGQVAGADFESEDEGEEFDDWEDDYDYPEEEQLSGAGYRSRQDVSENKRTSPGWRVSDAL

SEQ ID NO: 858207 - protein, 94 aa, Homo sapiens
YRGRLLLLNSRPRRTNYQERPKTPMALTLLLIQIIFLALGKISFIFVCCKDGFARISHDQDKLPIQKPTDTNYIMRKKCIQLGHISFELFGLKA

SEQ ID NO: 858208 - protein, 114 aa, Homo sapiens
MSEMAELSELYEESSDLQMDVMPGEGDLPQMEVGSGSRELSLRPSRSGAQQLEEEGPMEEEEAQPMAAPEGKRSLANGPNAGEQPGQVAGADFESSGKGSSAKGSSAKGSSAKG

SEQ ID NO: 858209 - protein, 187 aa, Homo sapiens; identical to SEQ ID NO: 858202

SEQ ID NO: 858210 - protein, 187 aa, Homo sapiens; identical to SEQ ID NO: 858202

SEQ ID NO: 858211 - protein, 187 aa, Homo sapiens; identical to SEQ ID NO: 858202

SEQ ID NO: 858212 - protein, 187 aa, Homo sapiens; identical to SEQ ID NO: 858202

SEQ ID NO: 858213 - protein, 1012 aa, Homo sapiens
MEEYEKFCEKSLARIQEASLSTESFLPAQSESISLIRFHGVAILSPLLNIEKRKEMQQEKQKALDVEARKQVNRKKALLTRVQEILDNVQVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSMNRIVNESHLDKEHDAVEVADCVKEKGQLTGKHCVSVIPDKPSLNKSNVLLQGASTQASSMSMPVLASFSKVDIPIRTGHPTVLESNSDFKVIPTFVTENNVIKSLTGSYAKLPSPEPSMSPKMHRRRSRTSSACHILINNPINACELSPKGKEQAMDLIIQDTDENTNVPEIMPKLPTDLAGVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNTRQQMDTPMVSCGNEQFLDNSFEKVKRRLDLDIDGLQKENCPYVITSGITEQERQHLPEKRYPKGSGFVNKNKMLGTSSKESEELLKSKMLAFEEMRKRLEEQHAQQLSLLIAEQEREQERLQKEIEEQEKMLKEKKAMTAEASELDINNAVELEWRKISDSSLLETMLSQADSLHTSNSNSSGFTNSAMQYSFVSANEAPFYLWGSSTSGLTKLSVTRPFGRAKTRWSQVFSLEIQAKFNKITAVAKGFLTRRLMQTDKLKQLRQTVKDTMEFIRSFQSEAPLKRGIVSAQDASLQERVLAQLRAALYGIHDIFFVMDAAERMSILHHDREVRKEKMLRQMDKMKSPRVALSAATQKSLDRKKYMKAAEMGMPNKKFLVKQNPSETRVLQPNQGQNAPVHRLLSRQGTPKTSVKGVVQNRQKPSQSRVPNRVPVSGVYAGKIQRKRPNVATI

SEQ ID NO: 858214 - protein, 969 aa, Homo sapiens
MEEYEKFCEKSLARIQEASLSTESFLPAQSESISLIRFHGVAILSPLVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSMNRIVNESHLDKEHDAVEVADCVKEKGQLTGKHCVSVIPDKPSLNKSNVLLQGASTQASSMSMPVLASFSKVDIPIRTGHPTVLESNSDFKVIPTFVTENNVIKSLTGSYAKLPSPEPSMSPKMHRRRSRTSSACHILINNPINACELSPKGKEQAMDLIIQDTDENTNVPEIMPKLPTDLAGVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNTRQQMDTPMVSCGNEQFLDNSFEKVKRRLDLDIDGLQKENCPYVITSGITEQERQHLPEKRYPKGSGFVNKNKMLGTSSKESEELLKSKMLAFEEMRKRLEEQHAQQLSLLIAEQEREQERLQKEIEEQEKMLKEKKAMTAEASELDINNAVELEWRKISDSSLLETMLSQADSLHTSNSNSSGFTNSAMQYSFVSANEAPFYLWGSSTSGLTKLSVTRPFGRAKTRWSQVFSLEIQAKFNKITAVAKGFLTRRLMQTDKLKQLRQTVKDTMEFIRSFQSEAPLKRGIVSAQDASLQERVLAQLRAALYGIHDIFFVMDAAERMSILHHDREVRKEKMLRQMDKMKSPRVALSAATQKSLDRKKYMKAAEMGMPNKKFLVKQNPSETRVLQPNQGQNAPVHRLLSRQGTPKTSVKGVVQNRQKPSQSRVPNRVPVSGVYAGKIQRKRPNVATI

SEQ ID NO: 858215 - protein, 1012 aa, Homo sapiens; identical to SEQ ID NO: 858213

SEQ ID NO: 858216 - protein, 1012 aa, Homo sapiens; identical to SEQ ID NO: 858213

SEQ ID NO: 858217 - protein, 204 aa, Homo sapiens
MIPRGRRCFVAETKLYGMAKGFLTRRLMQTDKLKQLRQTVKDTMEFIRSFQSEAPLKRGIVSAQDASLQERVLAQLRAALYGIHDIFFVMDAAERMSILHHDREVRKEKMLRQMDKMKSPRVALSAATQKSLDRKKYMKAAEMGMPNKKFLVKQNPSETRVLQPNQGQNAPVHRLLSRQGSICRKNPKKAAKCCDNLRRQHSLG

SEQ ID NO: 858218 - protein, 997 aa, Homo sapiens
MEEYEKFCEKSLARIQEASLSTESFLPAQSESISLIRFHGVAILSPLLNIEKRKEMQQEKQKALDVEARKQVNRKKALLTRVQEILDNVQVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSMNRIVNESHLDKEHDAVEVADCVKEKGQLTGKHCVSVIPDKPSLNKSNVLLQGASTQASSMSMPVLASFSKVDIPIRTGHPTVLESNSDFKVIPTFVTENNVIKSLTGSYAKLPSPEPSMSPKMHRRRSRTSSACHILINNPINACELSPKGKEQAMDLIIQDTDENTNVPEIMPKLPTDLAGVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNTRQQMDTPMVSCGNEQFLDNSFEKVKRRLDLDIDGLQKENCPYVITSGITEQERQHLPEKRYPKGSGFVNKNKMLGTSSKESEELLKSKMLAFEEMRKRLEEQHAQQLSLLIAEQEREQERLQKEIEEQEKMLKEKKAMTAEASELDINNAVELEWRKISDSSLLETMLSQADSLHTSNSNSSGFTNSAMQYSFVSANEAPFYLWGSSTSGLTKLSVTRPFGRAKTRWSQVFSLEIQAKFNKITAVAKGFLTRRLMQTDKLKQLRQTVKDTMEFIRSFQSEAPLKRGIVSAQDASLQERVLAQLRAALYGIHDIFFVMDAAERMSILHHDREVRKEKMLRQMDKMKSPRVALSAATQKSLDRKKYMKAAEMGMPNKKFLVKQNPSETRVLQPNQGQNAPVHRLLSRQGTPKTSVKGVVQNRQKPSQSRVPNRVPVSGL

SEQ ID NO: 858219 - protein, 991 aa, Homo sapiens
MEEYEKFCEKSLARIQEASLSTESFLPAQSESISLIRFHGVAILSPLLNIEKRKEMQQEKQKALDVEARKQVNRKKALLTRVQEILDNVQVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSMNRIVNESHLDKEHDAVEVADCVKEKGQLTGKHCVSVIPDKPSLNKSNVLLQGASTQASSMSMPVLASFSKVDIPIRTGHPTVLESNSDFKVIPTFVTENNVIKSLTGSYAKLPSPEPSMSPKMHRRRSRTSSACHILINNPINACELSPKGKEQAMDLIIQDTDENTNVPEIMPKLPTDLAGVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNTRQQMDTPMVSCGNEQFLDNSFEKVKRRLDLDIDGLQKENCPYVITSGITEQERQHLPEKRYPKGSGFVNKNKMLGTSSKESEELLKSKMLAFEEMRKRLEEQHAQQLSLLIAEQEREQERLQKEIEEQEKMLKEKKAMTAEASELDINNAVELEWRKISDSSLLETMLSQADSLHTSNSNSSGFTNSAMQYSFVSANEAPFYLWGSSTSGLTKLSVTRPFGRAKTRWSQVFSLEIQAKFNKITAVAKGFLTRRLMQTDKLKQLRQTVKDTMEFIRSFQSEAPLKRGIVSAQDASLQERVLAQLRAALYGIHDIFFVMDAAERMSILHHDREVRKEKMLRQMDKMKSPRVALSAATQKSLDRKKYMKAAEMGMPNKKFLVKQNPSETRVLQPNQGQNAPVHRLLSRQGSICRKNPKKAAKCCDNLRRQHSLG

SEQ ID NO: 858220 - protein, 1012 aa, Homo sapiens; identical to SEQ ID NO: 858213

SEQ ID NO: 858221 - protein, 364 aa, Homo sapiens [sequence omitted]

SEQ ID NO: 858222 - protein, 1003 aa, Homo sapiens
MEEYEKFCEKSLARIQEASLSTESFLPAQSESISLIRFHGVAILSPLLNIEKRKEMQQEKQKALDVEARKQVNRKKALLTRVQEILDNVQVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSMNRIVNESHLDKEHDAVEVADCVKEKGQLTGKHCVSVIPDKPSLNKSNVLLQGASTQASSMSMPVLASFSKVDIPIRTGHPTVLESNSDFKVIPTFVTENNVIKSLTGSYAKLPSPEPSMSPKMHRRRSRTSSACHILINNPINACELSPKGKEQAMDLIIQDTDENTNVPEIMPKLPTDLAGVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNTRQQMDTPMVSCGNEQFLDNSFEKVKRRLDLDIDGLQKENCPYVITSGITEQERQHLPEKRYPKGSGFVNKNKMLGTSSKESEELLKSKMLAFEEMRKRLEEQHAQQLSLLIAEQEREQERLQKEIEEQEKMLKEKKAMTAEASELDINNAVELEWRKISDSSLLETMLSQADSLHTSNSNSSGFTNSAMQYSFVSANEAPFYLWGSSTSGLTKLSVTRPFGRAKTRWSQVFSLEIQAKFNKITAVAKGFLTRRLMQTDKLKQLRQTVKDTMEFIRSFQSEAPLKRGIVSAQDASLQERVLAQLRAALYGIHDIFFVMDAAERMSILHHDREVRKEKMLRQMDKMKSPRVALSAATQKSLDRKKYMKNKKQKHNFVRARASRRPLERSSFSKHHLRFGARARAPQMGRKVHTGGPNTAWSPQRENTRGPQKNIRGGEESLSPTI

SEQ ID NO: 858223 - protein, 832 aa, Homo sapiens
MEEYEKFCEKSLARIQEASLSTESFLPAQSESISLIRFHGVAILSPLLNIEKRKEMQQEKQKALDVEARKQVNRKKALLTRVQEILDNVQVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSMNRIVNESHLDKEHDAVEVADCVKEKGQLTGKHCVSVIPDKPSLNKSNVLLQGASTQASSMSMPVLASFSKVDIPIRTGHPTVLESNSDFKVIPTFVTENNVIKSLTGSYAKLPSPEPSMSPKMHRRRSRTSSACHILINNPINACELSPKGKEQAMDLIIQDTDENTNVPEIMPKLPTDLAGVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNTRQQMDTPMVSCGNEQFLDNSFEKVKRRLDLDIDGLQKENCPYVITSGITEQERQHLPEKRYPKGSGFVNKNKMLGTSSKESEELLKSKMLAFEEMRKRLEEQHAQQLSLLIAEQEREQERLQKEIEEQEKMLKEKKAMTAEASELDINNAVELEWRKISDSSLLETMLSQADSLHTSNSNSSGFTNSAMQYSFVSANEAPFYLWGSSTSGLTKLSVTRPFGRAKTRWSQVFSLEIQAKFNKITAVAKGFLTRRLMQTDKLKQLRQTVKVRFL

SEQ ID NO: 858224 - protein, 120 aa, Homo sapiens
MVQPAPPSRSRTVGPSTCRKALWDGSLSFLPFGASLLWFLLWVLWDGAWLWPRGLSRRGAGRGNAATLSLVSRLRRPVSEVSGAVNKGSGLASGLRSHVWKRGASSICVYIIDYAREFSR

SEQ ID NO: 858225 - protein, 120 aa, Homo sapiens; identical to SEQ ID NO: 858224

SEQ ID NO: 858226 - protein, 120 aa, Homo sapiens; identical to SEQ ID NO: 858224

SEQ ID NO: 858227 - protein, 120 aa, Homo sapiens; identical to SEQ ID NO: 858224

SEQ ID NO: 858228 - protein, 120 aa, Homo sapiens; identical to SEQ ID NO: 858224

SEQ ID NO: 858229 - protein, 120 aa, Homo sapiens; identical to SEQ ID NO: 858224

SEQ ID NO: 858230 - protein, 1132 aa, Homo sapiens
MGANASNYPHSCSPRVGGNSQAQQTFIGTSSYSQQGYGCESKLYSLDHGHEKPQDKKKRTSGLATLKKKFIKRRKSNRSADHAKQMRELLSGWDVRDVNALVEEYEGTSALKELSLQASLARPEARTLQKDMADLYEYKYCTDVDLIFQETCFPVHRAILAARCPFFKTLLSSSPEYGAEIIMDINTAGIDMPMFSALLHYLYTGEFGMEDSRFQNVDILVQLSEEFGTPNSLDVDMRGLFDYMCYYDVVLSFSSDSELVEAFGGNQNCLDEELKAHKAVISARSPFFRNLLQRRIRTGEEITDRTLRTPTRIILDESIIPKKYATVILHCMYTDVVDLSVLHCSPSVGSLSEVQALVAGKPNMTRAEEAMELYHIALFLEFNMLAQGCEDIIAESISLDTLIAILKWSSHPYGSKWVHRQALHFLCEEFSQVMTSDVFYELSKDHLLTAIQSDYLQASEQDILKYLIKWGEHQLMKRIADREPNLLSGTAHSVNKRGVKRRDLDMEELREILSSLLPFVRIEHILPINSEVLSDAMKRGLISTPPSDMLPTTEGGKSNAWLRQKNAGIYVRPRLFSPYVEEAKSVLDEMMVEQTDLVRLRMVRMSNVPDTLYMVNNAVPQCCHMISHQQISSNQSSPPSVVANEIPVPRLLIMKDMVRRLQELRHTEQVQRAYALNCGEGATVSYEIQIRVLREFGLADAAAELLQNPHKFFPDERFGDESPLLTMRQPGRCRVNSTPPAETMFTDLDSFVAFHPPLPPPPPPYHPPATPIHNQLKAGWKQRPPSQHPSRSFSYPCNHSLFHSRTAPKAGPPPVYLPSVKAAPPDCTSTAGLGRQTVAAAAATTTSTATAAAAAASEKQVRTQPVLNDLMPDIAVGVSTLSLKDRRLPELAVDTELSQSVSEAGPGPPQHLSCIPQRHTHTSRKKHTLEQKTDTRENPQEYPDFYDFSNAACRPSTPALSRRTPSPSQGGYFGPDLYSHNKASPSGLKSAYLPGQTSPKKQEEARREYPLSPDGHLHRQKNEPIHLDVVEQPPQRSDFPLAAPENASTGPAHVRGRTAVETDLTFGLTPNRPSLSACSSEAPEERSGRRLADSESLGHGAQRNTDLEREDSISRGRRSPSKPDFLYKKSAL

SEQ ID NO: 858231 - protein, 1132 aa, Homo sapiens; identical to SEQ ID NO: 858230

SEQ ID NO: 858232 - protein, 757 aa, Homo sapiens
MINLKKYLPSLLGCEDIIAESISLDTLIAILKWSSHPYGSKWVHRQALHFLCEEFSQVMTSDVFYELSKDHLLTAIQSDYLQASEQDILKYLIKWGEHQLMKRIADREPNLLSGTAHSVNKRGVKRRDLDMEELREILSSLLPFVRIEHILPINSEVLSDAMKRGLISTPPSDMLPTTEGGKSNAWLRQKNAGIYVRPRLFSPYVEEAKSVLDEMMVEQTDLVRLRMVRMSNVPDTLYMVNNAVPQCCHMISHQQISSNQSSPPSVVANEIPVPRLLIMKDMVRRLQELRHTEQVQRAYALNCGEGATVSYEIQIRVLREFGLADAAAELLQNPHKFFPDERFGDESPLLTMRQPGRCRVNSTPPAETMFTDLDSFVAFHPPLPPPPPPYHPPATPIHNQLKAGWKQRPPSQHPSRSFSYPCNHSLFHSRTAPKAGPPPVYLPSVKAAPPDCTSTAGLGRQTVAAAAATTTSTATAAAAAASEKQVRTQPVLNDLMPDIAVGVSTLSLKDRRLPELAVDTELSQSVSEAGPGPPQHLSCIPQRHTHTSRKKHTLEQKTDTRENPQEYPDFYDFSNAACRPSTPALSRRTPSPSQGGYFGPDLYSHNKASPSGLKSAYLPGQTSPKKQEEARREYPLSPDGHLHRQKNEPIHLDVVEQPPQRSDFPLAAPENASTGPAHVRGRTAVETDLTFGLTPNRPSLSACSSEAPEERSGRRLADSESLGHGAQRNTDLEREDSISRGRRSPSKPDFLYKKSAL

SEQ ID NO: 858233 - protein, 546 aa, Homo sapiens [sequence omitted]

SEQ ID NO: 858234 - protein, 410 aa, Homo sapiens
MGANASNYPHSCSPRVGGNSQAQQTFIGTSSYSQQGYGCESKLYSLDHGHEKPQDKKKRTSGLATLKKKFIKRRKSNRSADHAKQMRELLSGWDVRDVNALVEEYEGTSALKELSLQASLARPEARTLQKDMADLYEYKYCTDVDLIFQETCFPVHRAILAARCPFFKTLLSSSPEYGAEIIMDINTAGIDMPMFSALLHYLYTGEFGMEDSRFQNVDILVQLSEEFGTPNSLDVDMRGLFDYMCYYDVVLSFSSDSELVEAFGGNQNCLDEELKAHKAVISARSPFFRNLLQRRIRTGEEITDRTLRTPTRIILDESIIPKKYATVILHCMYTDVVDLSVLHCSPSVGSLSEVQALVAGKPNMTRAEEAMELYHIALFLEFNMLAQEETTVIRPACAAELSNSCLLPQS

SEQ ID NO: 858235 - protein, 1132 aa, Homo sapiens; identical to SEQ ID NO: 858230

SEQ ID NO: 858236 - protein, 1132 aa, Homo sapiens; identical to SEQ ID NO: 858230

SEQ ID NO: 858237 - protein, 1132 aa, Homo sapiens; identical to SEQ ID NO: 858230

SEQ ID NO: 858238 - protein, 1132 aa, Homo sapiens; identical to SEQ ID NO: 858230

SEQ ID NO: 858239 - protein, 1132 aa, Homo sapiens; identical to SEQ ID NO: 858230

SEQ ID NO: 858240 - protein, 410 aa, Homo sapiens; identical to SEQ ID NO: 858234

SEQ ID NO: 858241 - protein, 589 aa, Homo sapiens
MSVSVHENRKSRASSGSINIYLFHKSSYADSVLTHLNLLRQQRLFTDVLLHAGNRTFPCHRAVLAACSRYFEAMFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 858242 - protein, 589 aa, Homo sapiens; identical to SEQ ID NO: 858241

SEQ ID NO: 858243 - protein, 589 aa, Homo sapiens; identical to SEQ ID NO: 858241

SEQ ID NO: 858244 - protein, 106 aa, Homo sapiens
MSVSVHENRKSRASSGSINIYLFHKSSYADSVLTHLNLLRQQRLFTDVLLHAGNRTFPCHRAVLAACSRYFEAMFSGGLKESQDSEVNFDNSSPEFDCVISTLRHI

SEQ ID NO: 858245 - protein, 589 aa, Homo sapiens; identical to SEQ ID NO: 858241

SEQ ID NO: 858246 - protein, 589 aa, Homo sapiens; identical to SEQ ID NO: 858241

SEQ ID NO: 858247 - protein, 589 aa, Homo sapiens; identical to SEQ ID NO: 858241

SEQ ID NO: 858248 - protein, 516 aa, Homo sapiens
MFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 858249 - protein, 350 aa, Homo sapiens
MYEAGWLIGRRGGGAAVALRRPGPDAWRPPAHKALSSSLPRAHSPPPSAAPAVAGLLCPTVTRSGDALRVLDTGSAAWGRQTEANAIGSRSASHRSGRSPLPGWPSFLRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 858250 - protein, 131 aa, Homo sapiens
MVRGWVVNRPRGGGAAVALRRPGPDAWRPPAHKALSSSLPRAHSPPPSAAPAVAGLLCPTVTRSGDALRVLDTGSAAWGRQTEANAIGSRSASHRSGRSPLPGWPSFLRGIRHRFPGLRRPVRRLLARDRR

SEQ ID NO: 858251 - protein, 131 aa, Homo sapiens; identical to SEQ ID NO: 858250

SEQ ID NO: 858252 - protein, 123 aa, Homo sapiens
MSGCRVFIGRLNPAAREKDVERFFKGYGRIRDIDLKRGFGFVEFEDPRDADDAVYELDGKELCSERVLSNMLVLLTRLYEYADRTLPREVAVDFELFAPFPRYPTSASSSDFISPRFVVLHFP

SEQ ID NO: 858253 - protein, 114 aa, Homo sapiens
LLGSLLFWGLCSFGVFAQEVVREIENQKTDAASKPFAEVRILSCGELDGKELCSERVTIEHARARSRGGRGRGRYSDRFSSRRPRNDRRNAPPVRTENRLIVENLSSRVSWQVC

SEQ ID NO: 858254 - protein, 97 aa, Homo sapiens
LLGSLLFWGLCSFGVFAQEVVREIENQKTDAASKPFAEVRILSCGELDGKELCSERVTIEHARARSRGGRGRGRYSDRFSSRRPRNDRRYVKGGWLH

SEQ ID NO: 858255 - protein, 114 aa, Homo sapiens; identical to SEQ ID NO: 858253

SEQ ID NO: 858256 - protein, 114 aa, Homo sapiens; identical to SEQ ID NO: 858253

SEQ ID NO: 858257 - protein, 114 aa, Homo sapiens; identical to SEQ ID NO: 858253

SEQ ID NO: 858258 - protein, 114 aa, Homo sapiens; identical to SEQ ID NO: 858253

SEQ ID NO: 858259 - protein, 114 aa, Homo sapiens; identical to SEQ ID NO: 858253

SEQ ID NO: 858260 - protein, 114 aa, Homo sapiens; identical to SEQ ID NO: 858253

SEQ ID NO: 858261 - protein, 114 aa, Homo sapiens; identical to SEQ ID NO: 858253

SEQ ID NO: 858262 - protein, 139 aa, Homo sapiens
LLGSLLFWGLCSFGVFAQEVVREIENQKTDAASKPFAEVRILSCGELDGKELCSERVTIEHARARSRGGRGRGRYSDRFSSRRPRNDRRNAPPVRTENRLIVENLSSRVSWQDLKDFMRQAGEVTFADAHRPKLNEGGG

SEQ ID NO: 858263 - protein, 114 aa, Homo sapiens; identical to SEQ ID NO: 858253

SEQ ID NO: 858264 - protein, 114 aa, Homo sapiens; identical to SEQ ID NO: 858253

SEQ ID NO: 858265 - protein, 114 aa, Homo sapiens; identical to SEQ ID NO: 858253

SEQ ID NO: 858266 - protein, 114 aa, Homo sapiens; identical to SEQ ID NO: 858253

SEQ ID NO: 858267 - protein, 114 aa, Homo sapiens; identical to SEQ ID NO: 858253

SEQ ID NO: 858268 - protein, 114 aa, Homo sapiens; identical to SEQ ID NO: 858253

SEQ ID NO: 858269 - protein, 114 aa, Homo sapiens; identical to SEQ ID NO: 858253

SEQ ID NO: 858270 - protein, 139 aa, Homo sapiens; identical to SEQ ID NO: 858262

SEQ ID NO: 858271 - protein, 149 aa, Homo sapiens
MSGCRVFIGRLNPAAREKDVERFFKGYGRIRDIDLKRGFGFVEFEDPRDADDAVYELDGKELCSERVTIEHARARSRGGRGRGRYSDRFSSRRPRNDRRNAPPVRTENRLIVENLSSRVSWQDLKDFMRQAGEVTFADAHRPKLNEGAG

SEQ ID NO: 858272 - protein, 114 aa, Homo sapiens; identical to SEQ ID NO: 858253

SEQ ID NO: 858273 - protein, 97 aa, Homo sapiens; identical to SEQ ID NO: 858254

SEQ ID NO: 858274 - protein, 114 aa, Homo sapiens; identical to SEQ ID NO: 858253

SEQ ID NO: 858275 - protein, 114 aa, Homo sapiens; identical to SEQ ID NO: 858253

SEQ ID NO: 858276 - protein, 114 aa, Homo sapiens; identical to SEQ ID NO: 858253

SEQ ID NO: 858277 - protein, 139 aa, Homo sapiens; identical to SEQ ID NO: 858262

SEQ ID NO: 858278 - protein, 114 aa, Homo sapiens; identical to SEQ ID NO: 858253

SEQ ID NO: 858279 - protein, 114 aa, Homo sapiens; identical to SEQ ID NO: 858253

SEQ ID NO: 858280 - protein, 114 aa, Homo sapiens; identical to SEQ ID NO: 858253

SEQ ID NO: 858281 - protein, 114 aa, Homo sapiens; identical to SEQ ID NO: 858253

SEQ ID NO: 858282 - protein, 114 aa, Homo sapiens; identical to SEQ ID NO: 858253

SEQ ID NO: 858283 - protein, 630 aa, Homo sapiens
MHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISHCHSLYVGAPSGVIQLPLSSCSRYRSCYDCILARDPYCGWDPGTHACAAATTIANRPRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 858284 - protein, 91 aa, Homo sapiens
ARGNSAASWNSLPEQMLFQASLSVPGWATASLTQPPSLHYPHLTFSWCILVSSLLLDLGYPPNCHILSGPLPQPHVVTSLSRAWERASLGR

SEQ ID NO: 858285 - protein, 527 aa, Homo sapiens
KGLRSQSSDYTGHVHPGTYTNTLERLVKEMEDTQRLDELQKQLQEDIRQGRGIKSPIRIGEEDSTDDEDGLLEEHKEFLKKFSVTIDAIPDHHPGEEIFNFLNSGKIFNQYTLDLRDSGFIGQSAVEKLILKSGKTDQIFLTTQGFLTSAYHYVQCPVPVLKWLFRMMSVHTDCIVSVQILSTLMEITIRNDTFSDSPVWPWIPSLSDVAAVFFNMGIDFRSLFPLENLQPDFNEDYLVSETQTTSRGKESEDSSYKPIFSTLPETNILNVVKFLGLCTSIHPEGYQDREIMLLILMLFKMSLEKQLKQIPLVDFQSLLINLMKNIRDWNTKVPELCLGINELSSHPHNLLWLVQLVPNWTSRGRQLRQCLSLVIISKLLDEKHEDVPNASNLQVSVLHRYLVQMKPSDLLKKMVLKKKAEQPDGIIDDSLHLELEKQAYYLTYILLHLVGEVSCSHSFSSGQRKHFVLLCGALEKHVKCDIREDARLFYRTKVKDLVARIHGKWQEIIQNCRPTQGQLHDFWVPDS

SEQ ID NO: 858286 - protein, 302 aa, Homo sapiens
IFLGIAAIVATVLRLCICNQQPVQNPTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 858287 - protein, 88 aa, Homo sapiens
LCVVLSPPFCPPLPVVMVVSLPKVTPPRLASCFLVSLPRSFFVSPPAPPSRLFILDASPFLSGRRPLLLPQQWRGGLPHFVCSSPGGR

SEQ ID NO: 858288 - protein, 441 aa, Homo sapiens
MAVVPASLSGQDVGSFAYLTIKDRIPQILTKVIDTLHRHKSEFFEKHGEEGVEAEKKAISLLSKLRNELQTDKPFIPLVEKFVDTDIWNQYLEYQQSLLNESDGKSRWFYSPWLLVECYMYRRIHEAIIQSPPIDYFDVFKESKEQNFYGSQESIIALCTHLQQLIRTIEDLDENQLKDEFFKLLQISLWGNKCDLSLSGGESSSQNTNVLNSLEDLKPFILLNDMEHLWSLLSNCKKTREKASATRVYIVLDNSGFELVTDLILADFLLSSELATEVHFYGKTIPWFVSDTTIHDFNWLIEQVKHSNHKWMSKCGADWEEYIKMGKWVYHNHIFWTLPHEYCAMPQVAPDLYAELQKAHLILFKGDLNYRKLTGDRKWEFSVPFHQALNGFHPAPLCTIRTLKAEIQVGLQPGQGEQLLASEPSWWTTGKYGIFQYDGPL

SEQ ID NO: 858289 - protein, 483 aa, Homo sapiens
AQDTGGPGRQSGHGGDLQIPILPPLFLRRLNSRALRPGSRKVMAVVPASLSGQDVGSFAYLTIKDRIPQILTKVIDTLHRHKSEFFEKHGEEGVEAEKKAISLLSKLRNELQTDKPFIPLVEKFVDTDIWNQYLEYQQSLLNESDGKSRWFYSPWLLVECYMYRRIHEAIIQSPPIDYFDVFKESKEQNFYGSQESIIALCTHLQQLIRTIEDLDENQLKDEFFKLLQISLWGNKCDLSLSGGESSSQNTNVLNSLEDLKPFILLNDMEHLWSLLSNCKKTREKASATRVYIVLDNSGFELVTDLILADFLLSSELATEVHFYGKTIPWFVSDTTIHDFNWLIEQVKHSNHKWMSKCGADWEEYIKMGKWVYHNHIFWTLPHEYCAMPQVAPDLYAELQKAHLILFKGDLNYRKLTGDRKWEFSVPFHQALNGFHPAPLCTIRTLKAEIQVGLQPGQGEQLLASEPSWWTTGKYGIFQYDGPL

SEQ ID NO: 858290 - protein, 441 aa, Homo sapiens; identical to SEQ ID NO: 858288

SEQ ID NO: 858291 - protein, 322 aa, Homo sapiens
MYRRIHEAIIQSPPIDYFDVFKESKEQNFYGSQESIIALCTHLQQLIRTIEDLDENQLKDEFFKLLQISLWGNKCDLSLSGGESSSQNTNVLNSLEDLKPFILLNDMEHLWSLLSNCKKTREKASATRVYIVLDNSGFELVTDLILADFLLSSELATEVHFYGKTIPWFVSDTTIHDFNWLIEQVKHSNHKWMSKCGADWEEYIKMGKWVYHNHIFWTLPHEYCAMPQVAPDLYAELQKAHLILFKGDLNYRKLTGDRKWEFSVPFHQALNGFHPAPLCTIRTLKAEIQVGLQPGQGEQLLASEPSWWTTGKYGIFQYDGPL

SEQ ID NO: 858292 - protein, 152 aa, Homo sapiens
MAVVPASLSGQDVGSFAYLTIKDRIPQILTKVIDTLHRHKSEFFEKHGEEGVEAEKKAISLLSKLRNELQTDKPFIPLVEKFVDTDIWNQYLEYQQSLLNESDGKSRWFYSPWLLVECYMYRRIHEAIIQSPPIDYFDVFKESKEQTIDKNY

SEQ ID NO: 858293 - protein, 441 aa, Homo sapiens; identical to SEQ ID NO: 858288

SEQ ID NO: 858294 - protein, 441 aa, Homo sapiens; identical to SEQ ID NO: 858288

SEQ ID NO: 858295 - protein, 447 aa, Homo sapiens
RKTQEAQAGSQDMAAFADSNLTASVSAAIEQPSFAAGIAESDGCRPGVSLRTGRGEGVEAEKKAISLLSKLRNELQTDKPFIPLVEKFVDTDIWNQYLEYQQSLLNESDGKSRWFYSPWLLVECYMYRRIHEAIIQSPPIDYFDVFKESKEQNFYGSQESIIALCTHLQQLIRTIEDLDENQLKDEFFKLLQISLWGNKCDLSLSGGESSSQNTNVLNSLEDLKPFILLNDMEHLWSLLSNCKKTREKASATRVYIVLDNSGFELVTDLILADFLLSSELATEVHFYGKTIPWFVSDTTIHDFNWLIEQVKHSNHKWMSKCGADWEEYIKMGKWVYHNHIFWTLPHEYCAMPQVAPDLYAELQKAHLILFKGDLNYRKLTGDRKWEFSVPFHQALNGFHPAPLCTIRTLKAEIQVGLQPGQGEQLLASEPSWWTTGKYGIFQYDGPL

SEQ ID NO: 858296 - protein, 556 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 858297 - protein, 112 aa, Homo sapiens
MPRRKEGQPGRGLRPERWLADRLPMAFASVCRPHAADPVSRTRRASPERVTVGQSKPATAGAAEGGGLCARGRELESALCAGGRQASGPGLRSATAAPPPLRLPEQSAPRRR

SEQ ID NO: 858298 - protein, 556 aa, Homo sapiens; identical to SEQ ID NO: 858296

SEQ ID NO: 858299 - protein, 556 aa, Homo sapiens; identical to SEQ ID NO: 858296

SEQ ID NO: 858300 - protein, 556 aa, Homo sapiens; identical to SEQ ID NO: 858296

SEQ ID NO: 858301 - protein, 571 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLEESRNDAVFFISAYQDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 858302 - protein, 237 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLMTSLSHIRASLFLS

SEQ ID NO: 858303 - protein, 544 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVEGLASFL

SEQ ID NO: 858304 - protein, 331 aa, Homo sapiens
MAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 858305 - protein, 583 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVELGIAGPPLELVCYPVKLYNAGEKGQIVYTTFFEPVTQFNGLDNQF

SEQ ID NO: 858306 - protein, 470 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKVLRNRNNFSLVEKLVYGENMWMQLTSLQDYGLGQVLLVRDSGVPKMSEIWMTPMTD

SEQ ID NO: 858307 - protein, 315 aa, Homo sapiens
MESWGQSITLPELRNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 858308 - protein, 415 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKI

SEQ ID NO: 858309 - protein, 390 aa, Homo sapiens [sequence omitted]

SEQ ID NO: 858310 - protein, 101 aa, Homo sapiens
KKNQKQSQREKPTRKPTAAGPSAPNGREQKDEKPRGTKKQLNTNLTPLPRASAVGERLWSSKDVRDMDDAYDRLTRHRCRMVERGIAAQPLYAGYCNHENM

SEQ ID NO: 858311 - protein, 245 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLSQALKVTVFLAYVTVFPISSFE

SEQ ID NO: 858312 - protein, 171 aa, Homo sapiens [sequence omitted]

SEQ ID NO: 858313 - protein, 226 aa, Homo sapiens
EVFHFISSQMNELIWKHLTNLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 858314 - protein, 556 aa, Homo sapiens; identical to SEQ ID NO: 858296

SEQ ID NO: 858315 - protein, 556 aa, Homo sapiens; identical to SEQ ID NO: 858296

SEQ ID NO: 858316 - protein, 538 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVE

SEQ ID NO: 858317 - protein, 739 aa, Homo sapiens
MWINSVFHLQAHQFLSFVTNNVNTTDQETSFSESSFHSFSIDISAAVNMPALRVSVMAPTFLQAGEDATWANHPARSALEAAGSDAARHSPPGKRCFPQRREADCILSSAPRFPSGSPQTLHRGGEAGRPLRRCPASACCGRAAAGTVISAPRRAPLAPSRSSRVLGARSPLANTPLQPKQPLKPAAPATGPGQWGKLTAVATGRNAQLSSSDGHGQGGDEPVVSAQGSGGECPGERRASRGEDCAPNDGSRTGYRWRSPPSVVPTPRTRCPGPAERLRSASRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 858318 - protein, 538 aa, Homo sapiens; identical to SEQ ID NO: 858316

SEQ ID NO: 858319 - protein, 544 aa, Homo sapiens; identical to SEQ ID NO: 858303

SEQ ID NO: 858320 - protein, 331 aa, Homo sapiens; identical to SEQ ID NO: 858304

SEQ ID NO: 858321 - protein, 415 aa, Homo sapiens; identical to SEQ ID NO: 858308

SEQ ID NO: 858322 - protein, 485 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGAQKQKQLFIVQEC

SEQ ID NO: 858323 - protein, 316 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKAERPPDSMLQHRWLQL

SEQ ID NO: 858324 - protein, 302 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILMKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 858325 - protein, 130 aa, Homo sapiens
AAALPLIRAGREVGSRGSGSADRAESSRAAMELCGLGLPRPPMLLALLLATLLAAMLALLTQVALVVQVAEAARAPSVSAKPGPALWPLPLSVKMTPNLLHLAPENFYISHSPNSTAGPSCTLLEEAFRR

SEQ ID NO: 858326 - protein, 1447 aa, Homo sapiens
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 858327 - protein, 1529 aa, Homo sapiens
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQKGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 858328 - protein, 254 aa, Homo sapiens [sequence omitted]

SEQ ID NO: 858329 - protein, 160 aa, Homo sapiens [sequence omitted]

SEQ ID NO: 858330 - protein, 1486 aa, Homo sapiens
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQKGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 858331 - protein, 254 aa, Homo sapiens [sequence omitted]

SEQ ID NO: 858332 - protein, 674 aa, Homo sapiens
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKAMVETVNNLLQPQALNAWRDLTTSDQLRAATMLLHTVEESAFVWSCKFVYQ

SEQ ID NO: 858333 - protein, 261 aa, Homo sapiens
PALRRAAPRYCCGGRWGAQLGRGSEGRLGGRARPEAEAGPGCGAEAQHGLALGPTFPAAPGSSGRTGIANWRPHCTATSTTLNRRTPAADPTGAGRVSGKPGVCESAPSTQCQRGQREPPGLGSAVLQEAVSTGDPEMVQLVLQYRDYQRATQRLAGIPELLNKLRQAQGHVGKRDGQAHVGETGPFGREALPALGLLKNADYLEQGLQVDSVDYGLKPWNTCYYAPFWKHTEGPGWQSILSHTPYPRSRLGGSHCAPFTE

SEQ ID NO: 858334 - protein, 309 aa, Homo sapiens
PALRRAAPRYCCGGRWGAQLGRGSEGRLGGRARPEAEAGPGCGAEAQHGLALGPTFPAAPGSSGRTGIANWRPHCTATSTTLNRRTPAADPTGAGRVSGKPGVCESAPSTQCQRGQREPPGLGSAVLQEAVSTGDPEMVQLVLQYRDYQRATQRLAGIPELLNKLRQVQQGTVMEVGYHGRAPPWLLCQAWPWKGTQFVQCASCHQQGGLSILTPAQGHVGKRDGQAHVGETGPFGREALPALGLLKNADYLEQGLQVDSVDYGLKPWNTCYYAPFWKHTEGPGWQSILSHTPYPRSRLGGSHCAPFTE

SEQ ID NO: 858335 - protein, 233 aa, Homo sapiens
PALRRAAPRYCCGGRWGAQLGRGSEGRLGGRARPEAEAGPGCGAEAQHGLALGPTFPAAPGSSGRTGIANWRPHCTATSTTLNRRTPAADPTGAGRVSGKPGVCESAPSTQCQRGQREPPGLGSAVLQEAVSTGDPEMVQLVLQYRDYQRATQRLAGIPELLNKLRQAPDFYVEMKWEFTSWVPLVSKMCPSDVYRVWKRGESLRVDTSLLGFEHMTWQRGRRSFIFKGQGEL

SEQ ID NO: 858336 - protein, 270 aa, Homo sapiens
MACRPRSPPRHQSRCDGDASPPSPARWSLGRKRRADGRRWRPEDAEEAEHRGAERRPESFTTPEGPKPRSRCSDWASAVEEDEMRTRVNKEMARYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEIHPVDLESAESSSEPQTSSQDDFDVYSGTPTKVRHMDSQVEDEFDLEACLTEPLRDFSAMS

SEQ ID NO: 858337 - protein, 235 aa, Homo sapiens
MACRPRSPPRHQSRCDGDASPPSPARWSLGRKRRADGRRWRPEDAEEAEHRGAERRPERYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEIHPVDLESAESSSEPQTSSQDDFDVYSGTPTKVRHMDSQVEDEFDLEACLTEPLRDFSAMS

SEQ ID NO: 858338 - protein, 300 aa, Homo sapiens
MACRPRSPPRHQSRCDGDASPPSPARWSLGRKRRADGRRWRPEDAEEAEHRGAERRPESFTTPEGPKPRSRCSDWASAVEEDEMRTRVNKEMARYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEMYVFIAFLSCDSLIGPVTGAAAHHWDRRSGAKSPSSCWGAEQLLQLGAEFFCTGREAAGRKSLLPGLNLFFQAKSIWEIQFLFVVLLFLLL

SEQ ID NO: 858339 - protein, 270 aa, Homo sapiens; identical to SEQ ID NO: 858336

SEQ ID NO: 858340 - protein, 77 aa, Homo sapiens
EDQVPVDEVVAHAETPVSARYLNGRSCCRDTITSSQDDFDVYSGTPTKVRHMDSQVEDEFDLEACLTEPLRDFSAMS

SEQ ID NO: 858341 - protein, 782 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 858342 - protein, 169 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARS

SEQ ID NO: 858343 - protein, 851 aa, Homo sapiens
RRPVQRPPPATPDPGVWLPPSRDPAMAKRSSLYIRIVEGKNLPAKDITGSSDPYCIVKVDNEPIIRYRPHPQDRGALSLSSARALPAKGTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 858344 - protein, 813 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 858345 - protein, 725 aa, Homo sapiens
LPPSPSSSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDELEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 858346 - protein, 617 aa, Homo sapiens
CLYLLFIFGGLCGLVFGRELHPHQANHGARNRDSRKGKAGHCLLHPFTAQSRTGSGDVRSWPVSRAPSPATPWENVLFPWDALRSSEGKVRDPPCLSLQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 858347 - protein, 871 aa, Homo sapiens
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHEVRPPPAGLGWAGLDWAGARGEERWGTRERWGGPGRLCRSEGQGRSLREGAARSPGLGDSSPRSSAPLQNVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 858348 - protein, 782 aa, Homo sapiens; identical to SEQ ID NO: 858341

SEQ ID NO: 858349 - protein, 205 aa, Homo sapiens [sequence omitted]

SEQ ID NO: 858350 - protein, 205 aa, Homo sapiens [sequence omitted]

SEQ ID NO: 858351 - protein, 851 aa, Homo sapiens; identical to SEQ ID NO: 858343

SEQ ID NO: 858352 - protein, 799 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHEVRPPPAGLGWAGLDWAGARGEERWGTRERWGGPGRLCRSEGQGRSLREGAARSPGLGDSSPRSSAPLQNVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGGRGG

SEQ ID NO: 858353 - protein, 726 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKVRGGERVLWEWPEHCGSGLGAVGEAWVLWEWHESCGSGLGIVGEA

SEQ ID NO: 858354 - protein, 130 aa, Homo sapiens [sequence omitted]

SEQ ID NO: 858355 - protein, 130 aa, Homo sapiens [sequence omitted]

SEQ ID NO: 858356 - protein, 636 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHEVRPPPAGLGWAGLDWAGARGEERWGTRERWGGPGRLCRSEGQGRSLRGGGCQEPWSGGLQPALFRTPPECTVHRRHQLPVPALLLSRHHVAQALPPAGAPRGRPHQPHPAPVGQGAGLAATGGMHSWVSYRGPGLDCRVFPTGSGEATGTPT

SEQ ID NO: 858357 - protein, 627 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDGERRPAQTRPQPTADVCSALEPHGPTHRCLFLSWPHPPPAVGICQAPRP

SEQ ID NO: 858358 - protein, 214 aa, Homo sapiens
RRPVQRPPPATPDPGVWLPPSRDPAMAKRSSLYIRIVEGKNLPAKDITGSSDPYCIVKVDNEPIIRYRPHPQDRGALSLSSARALPAKGTATVWKTLCPFWGEEYQVHLPPTFHAVAFYVMDEDALSRDDVIGKVCLTRDTIASHPKGKFSLPSHTGLPSPWPPSHSETSPLGSVWSPAQGKPFLLSPEAGATFCTPGLCSAACSQAWLLLPLP

SEQ ID NO: 858359 - protein, 828 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 858360 - protein, 828 aa, Homo sapiens; identical to SEQ ID NO: 858359

SEQ ID NO: 858361 - protein, 851 aa, Homo sapiens; identical to SEQ ID NO: 858343

SEQ ID NO: 858362 - protein, 611 aa, Homo sapiens
MEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 858363 - protein, 851 aa, Homo sapiens; identical to SEQ ID NO: 858343

SEQ ID NO: 858364 - protein, 1009 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHEVRPPPAGLGWAGLDWAGARGEERWGTRERWGGPGRLCRSEGQGRSLRGGGCQEPWSGGLQPALFRTPPECTVHRRHQLPVPALLLSRHHVAQALPPAGAPRGRPHQPHPAPVGQGAGLAGHGRDAQLGVLPGPWPGLQSVPYRLRRGHWHAHVGTALHSLQSLPVATLSESISWIREQACEGSGVAKAAHPVGGESRDLPTQVCLLSGCTYVPGTGVGYPVQQRQLNAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 858365 - protein, 851 aa, Homo sapiens; identical to SEQ ID NO: 858343

SEQ ID NO: 858366 - protein, 205 aa, Homo sapiens [sequence omitted]

SEQ ID NO: 858367 - protein, 952 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWITINKDTKVPNACLFTINKEDHTLGNIIKSRACFPFAFCRDCQFPEASPATLPVQPAELLAWKSPCATGKDINKHQEVSKSTRSHRHHVDVHLPVFPGKILLNCAALAKRAAPEHISYVPQLSNDTLAGRLTLSTFTLEQPLGQFSSHNISDLDTIWLVGPSARHPELRPRQTGLRSALSRGSIS

SEQ ID NO: 858368 - protein, 906 aa, Homo sapiens
RRPVQRPPPATPDPGVWLPPSRDPAMAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKCVNELNQWLSALRKVSINNTGLLGSYHPGVFRGDKWSCCHQKEKTGQGCDKTRSRVTLQEWNDPLDHDLEAQLIYRHLLGVEAMLWITINKDTKVPNACLFTINKEDHTLGNIIKSRACFPFAFCRDCQFPEASPATLPVQPAELLAWKSPCATGKDINKHQEVSKSTRSHRHHVDVHLPVFPGKILLNCAALAKRAAPEHISYVPQLSNDTLAGRLTLSTFTLEQPLGQFSSHNISDLDTIWLVGPSARHPELRPRQTGLRSALSRGSIS

SEQ ID NO: 858369 - protein, 130 aa, Homo sapiens [sequence omitted]

SEQ ID NO: 858370 - protein, 636 aa, Homo sapiens; identical to SEQ ID NO: 858356

SEQ ID NO: 858371 - protein, 94 aa, Homo sapiens
YYYYYYYQIRALDQGLGFPVDHRSKNLQGPASPPSPVFPTLARPSRCRNMQAPLQDCGRSVSLRLACVLAPLTTSSRGCHLQLPQDKGKAREDS

SEQ ID NO: 858372 - protein, 615 aa, Homo sapiens
MGGWKGPGQRRGKEGPEARRRAAERGGGGGGGGVPAPRSPAREPRPRSCLLLPPPWGAAMTPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 858373 - protein, 652 aa, Homo sapiens
MGGWKGPGQRRGKEGPEARRRAAERGGGGGGGGVPAPRSPAREPRPRSCLLLPPPWGAAMTPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 858374 - protein, 652 aa, Homo sapiens; identical to SEQ ID NO: 858373

SEQ ID NO: 858375 - protein, 611 aa, Homo sapiens
MLQLVAPRPRGCAPLGGTQKPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 858376 - protein, 1185 aa, Homo sapiens
CPWKGQGSRAESPWKGQGSLHECPHIPTPVCIGHRDAPSFSSPPRQAPEPSLFFQDPPGTSMESLAPSTDSLHGSPVLIPQVCIGHRDAPRASSPPRHPPSDLAFLAPSPSPGSSGGSRGSAPPGETRHNLEREEYTVLADLPPPRRLAQRQPGPQAQCSSGGRTHSPGRAEVERLFGQERRKSEAAGAFQAQDEGRSQQPSQGQSQLLRRQSSPAPSRQVTMLPAKQAELTRRSQAEPPHPWSPEKRPEGDRQLQGSPLPPRTSARTPERELRTQRPLESGQAGPRQPLGVWQSQEEPPGSQGPHRHLERSWSSQEGGLGPGGWWGCGEPSLGAAKAPEGAWGGTSREYKESWGQPEAWEEKPTHELPRELGKRSPLTSPPENWGGPAESSQSWHSGTPTAVGWGAEGACPYPRGSERRPELDWRDLLGLLRAPGEGVWARVPSLDWEGLLELLQARLPRKDPAGHRDDLARALGPELGPPGTNDVPEQESHSQPEGWAEATPVNGHSPALQSQSPVQLPSPACTSTQWPKIKVTRGPATATLAGLEQTGPLGSRSTAKGPSLPELQFQPEEPEESEPSRGQDPLTDQKQADSPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 858377 - protein, 639 aa, Homo sapiens
MGGWKGPGQRRGKEGPEARRRAAERGGGGGGGGVPAPRSPAREPRPRSCLLLPPPWGAAMTPDLLNFKKGWMSILDEPGEWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 858378 - protein, 652 aa, Homo sapiens; identical to SEQ ID NO: 858373

SEQ ID NO: 858379 - protein, 246 aa, Homo sapiens
MNLLLQCLLLLLALQLPLVVPLQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 858380 - protein, 578 aa, Homo sapiens
MGGWKGPGQRRGKEGPEARRRAAERGGGGGGGGVPAPRSPAREPRPRSCLLLPPPWGAAMTPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVSVLTSTR

SEQ ID NO: 858381 - protein, 328 aa, Homo sapiens
AAAYYYYYCSEFKLLTMYGDMAPQPPSRLCWVQNRQSHPKGVSLLLPEPLNLIKRSSRKKKKKKKKTKFLGASRKSFINPIGCGGEGPRVGNSVTTCPNALSQSETRGQKHRGWGFSHPNKKTAREEPQTCSGTKPQKGRSTEATNRDTYKTGSLTSRTRIIKIKPRQWRKRTATTHKEERKQAKAKPRRATAEREEHENRRHDRKRKHNNDGKQEAENEHEKRRRNKSNTGTRTEAIQRKTRDGASEEGRDDERERAERGGGEGAERAARTKEQKRTGRRKGRERSAEARGRKKRGRRKEKGEGERRAEKKGERDQERRRREGKGRA

SEQ ID NO: 858382 - protein, 652 aa, Homo sapiens; identical to SEQ ID NO: 858373

SEQ ID NO: 858383 - protein, 1231 aa, Homo sapiens
CPWKGQGSRAESPWKGQGSLHECPHIPTPVCIGHRDAPSFSSPPRQAPEPSLFFQDPPGTSMESLAPSTDSLHGSPVLIPQVCIGHRDAPRASSPPRHPPSDLAFLAPSPSPGSSGGSRGSAPPGETRHNLEREEYTVLADLPPPRRLAQRQPGPQAQCSSGGRTHSPGRAEVERLFGQERRKSEAAGAFQAQDEGRSQQPSQGQSQLLRRQSSPAPSRQVTMLPAKQAELTRRSQAEPPHPWSPEKRPEGDRQLQGSPLPPRTSARTPERELRTQRPLESGQAGPRQPLGVWQSQEEPPGSQGPHRHLERSWSSQEGGLGPGGWWGCGEPSLGAAKAPEGAWGGTSREYKESWGQPEAWEEKPTHELPRELGKRSPLTSPPENWGGPAESSQSWHSGTPTAVGWGAEGACPYPRGSERRPELDWRDLLGLLRAPGEGVWARVPSLDWEGLLELLQARLPRKDPAGHRDDLARALGPELGPPGTNDVPEQESHSQPEGWAEATPVNGHSPALQSQSPVQLPSPACTSTQWPKIKVTRGPATATLAGLEQTGPLGSRSTAKGPSLPELQFQPEEPEESEPSRGQDPLTDQKQADSADKRPAEGKAGSPLKGRLVTSWRMPGDRPTLFNPFLLSLGVLRWRRPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 858384 - protein, 682 aa, Homo sapiens
MGGWKGPGQRRGKEGPEARRRAAERGGGGGGGGVPAPRSPAREPRPRSCLLLPPPWGAAMTGIQGGAGMPTYWVPRLWLWKVLDLQLSQAPPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 858385 - protein, 652 aa, Homo sapiens; identical to SEQ ID NO: 858373

SEQ ID NO: 858386 - protein, 652 aa, Homo sapiens; identical to SEQ ID NO: 858373

SEQ ID NO: 858387 - protein, 431 aa, Homo sapiens
MGGWKGPGQRRGKEGPEARRRAAERGGGGGGGGVPAPRSPAREPRPRSCLLLPPPWGAAMTPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQLVGVITVPVLQTRPLSSERLCDLPKVTPPAGLKGGI

SEQ ID NO: 858388 - protein, 60 aa, Homo sapiens
VLLRVKENELQYLKKEVQCLRDELQMMQKVGPSAGLGAVGDSGAIWMPSCEHLLCAKPST

SEQ ID NO: 858389 - protein, 393 aa, Homo sapiens
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENGDKRKCG

SEQ ID NO: 858390 - protein, 393 aa, Homo sapiens; identical to SEQ ID NO: 858389

SEQ ID NO: 858391 - protein, 523 aa, Homo sapiens
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENREQEMRMGDMGPRGAINMGDAFSPAPAGNQGPPPMMGMNMNNRATIPGPPMGPGPAMGPEGAANMGTPMMPDNGAVHNDRFPQGPPSQMGSPMGSRTGSETPQAPMSGVGPVSGGPGGFGRGSQGGNFEGPNKRRRY

SEQ ID NO: 858392 - protein, 530 aa, Homo sapiens
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENFKGRNQMREQEMRMGDMGPRGAINMGDAFSPAPAGNQGPPPMMGMNMNNRATIPGPPMGPGPAMGPEGAANMGTPMMPDNGAVHNDRFPQGPPSQMGSPMGSRTGSETPQAPMSGVGPVSGGPGGFGRGSQGGNFEGPNKRRRY

SEQ ID NO: 858393 - protein, 415 aa, Homo sapiens
MCSCSGRELGEPVSGVRGELSKMMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENGDKRKCG

SEQ ID NO: 858394 - protein, 523 aa, Homo sapiens; identical to SEQ ID NO: 858391

SEQ ID NO: 858395 - protein, 393 aa, Homo sapiens; identical to SEQ ID NO: 858389

SEQ ID NO: 858396 - protein, 393 aa, Homo sapiens; identical to SEQ ID NO: 858389

SEQ ID NO: 858397 - protein, 393 aa, Homo sapiens; identical to SEQ ID NO: 858389

SEQ ID NO: 858398 - protein, 523 aa, Homo sapiens; identical to SEQ ID NO: 858391

SEQ ID NO: 858399 - protein, 525 aa, Homo sapiens
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENREQEMRMGDMGPRGAINMGDAFSPAPAGNQGPPPMMGMNMNNRATIPGPPMGPGPAMGPEGAANMGTPMMPDNGAVHNDRFPQGPPSQMGSPMGSRTGSETPQAPMSGVGPVSGGPGGFGRGSQGGNFEGPNKRRCYTF

SEQ ID NO: 858400 - protein, 429 aa, Homo sapiens
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENREQEMRMGDMGPRGAINMGDAFSPAPAGNQGPPPMMGMNILNI

SEQ ID NO: 858401 - protein, 123 aa, Homo sapiens
CGQVGCGLVGQYRATSYQWCSALRVERGLSQPLAGRAGVPSGASWGTQLPHPSATPGPPPGPLWFSLVPSSTPGPQKSLVHSSLDLRPEIDPLPPEAWSKSKYAFLSSQMPACHSACQSRQGL

SEQ ID NO: 858402 - protein, 137 aa, Homo sapiens
ISLLRAGTTGACHHIRLIFVFLVEMGFCHVGQAGLELLSSGDLPTSASQSSGITGVSHGAQPGSCFLRRGFTLFPRLEYSGAVMTYCSLELFGSSSPPHSASLVAGAPGMNHRARLSFFKIFCRENLSLLHRLFLNS

SEQ ID NO: 858403 - protein, 1118 aa, Homo sapiens
PERSVGKSGLRDSTRGCPSGFPASLGAQQSKASGHKEYGSNVIGVMKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYLEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 858404 - protein, 1118 aa, Homo sapiens; identical to SEQ ID NO: 858403

SEQ ID NO: 858405 - protein, 304 aa, Homo sapiens
SGVGGRRRQRQRLRAARGAQGAGRSPSGLGRRAVGTGSPVPAPPLRRGAASGRPGRGRHRRHKMSLLSAIDTSAASVYQPAQLLNWVYLSLQDTHQASAFDAFRPEPTAGAAPPELAFGKGRPEQLGSPLHSSYLNSFFQLQRGEALSNSVYKGASPYGSLNNIADGLSSLTEHFSDLTLTSEARKPSKRPPPNYLCHLCFNKGHYIKDCPQARPKGEGLTPYQGKKRCFGEYKCPKCKRKWMSGNSWANMGQECIKCHINVYPHKQRPLEKPDGLDVSDQSKEHPQHLCEKCKVLGYYCRRVQ

SEQ ID NO: 858406 - protein, 304 aa, Homo sapiens; identical to SEQ ID NO: 858405

SEQ ID NO: 858407 - protein, 68 aa, Homo sapiens
YKCPKCKRKWMSGNSWANMGQECIKCHINVYPHKQVSRAGWGLLRRTAGGQLFPYRTSVYSLLQGRSL

SEQ ID NO: 858408 - protein, 452 aa, Homo sapiens
RGARWPQRLRARPKPGRSAEPPPRPCGSRPGGLGWGPRRPPRSAPAEPEPDPGRLPPGTMVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRYRRRAPATKQLFHFLFSICS

SEQ ID NO: 858409 - protein, 112 aa, Homo sapiens
MPRAGLSPRPGRLEAEVPGPTHTPSASGCPGPNQEGRKVTPRTGDTRQGPVGLEILRHQPLAHRPALHVAVLRANGHRAHVQVPPPGTCHQATVSFFIFHLFLNPTFCCSLF

SEQ ID NO: 858410 - protein, 901 aa, Homo sapiens
RGARWPQRLRARPKPGRSAEPPPRPCGSRPGGLGWGPRRPPRSAPAEPEPDPGRLPPGTMVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 858411 - protein, 913 aa, Homo sapiens
RGARWPQRLRARPKPGRSAEPPPRPCGSRPGGLGWGPRRPPRSAPAEPEPDPGRLPPGTMVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 858412 - protein, 549 aa, Homo sapiens
GLLAQSPECLAYSMGVPSAPFPPRPALLGAPLAACPSPTALSFPPQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 858413 - protein, 120 aa, Homo sapiens
MANMVNFRICLFQHRKTKQRHRERKSSQARFSLTYRLMPRAGLSPRPGRLEAEVPGPTHTPSASGCPGPNQEGRKVTPRTGDTRQGPGKSHEKERTQPPCELAQGPESSPNRSPPSGPTV

SEQ ID NO: 858414 - protein, 285 aa, Homo sapiens
PSPRTSLGPPHFLGLAWVPHFLGLAWVSPVSWNQPGPPHFLGAARVPTSPGTSLGPPFPGTSLGLSCFLEPAWAPPFPGSSLGPHISWDGPSTPAQQPLLQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKEN

SEQ ID NO: 858415 - protein, 903 aa, Homo sapiens
RGARWPQRLRARPKPGRSAEPPPRPCGSRPGGLGWGPRRPPRSAPAEPEPDPGRLPPGTMVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 858416 - protein, 117 aa, Homo sapiens
MEFARGLSPGHKADQNVCVMRFLVSKRKFKESLRPYDVMDVIEQYSAGHLDMLSRIKSLQSRQEPRLPVQQGTRTGWASGTKPTVAHGGSAGGVWAGPPPHPRRPLSASVVSSQSLF

SEQ ID NO: 858417 - protein, 901 aa, Homo sapiens; identical to SEQ ID NO: 858410

SEQ ID NO: 858418 - protein, 931 aa, Homo sapiens
RGARWPQRLRARPKPGRSAEPPPRPCGSRPGGLGWGPRRPPRSAPAEPEPDPGRLPPGTMVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSKGSPCRGPLCGCCPGRSSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 858419 - protein, 447 aa, Homo sapiens
RGARWPQRLRARPKPGRSAEPPPRPCGSRPGGLGWGPRRPPRSAPAEPEPDPGRLPPGTMVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQVSPGVPRGPAQPLSWSHLVEEWRPLGLWHCPVCGWATALTLCRNLWK

SEQ ID NO: 858420 - protein, 246 aa, Homo sapiens
MFPPARGKELLSFEDVAMYFTREEWGHLNWGQKDLYRDVMLENYRNMVLLGFQFPKPEMICQLENWDEQWILDLPRTGNRKASGSACPGSEARHKMKKLTPKQKFSEDLESYKISVVMQESAEKLSEKLHKCKEFVDSCRLTFPTSGDEYSRGFLQNLNLIQDQNAQTRWKQGRYDEDGKPFNQRSLLLGHERILTRAKSYECSECGKVIRRKAWFDQHQRIHFLENPFECKVCGQAFRQRSALTV

SEQ ID NO: 858421 - protein, 229 aa, Homo sapiens
MYFTREEWGHLNWGQKDLYRDVMLENYRNMVLLGFQFPKPEMICQLENWDEQWILDLPRTGNRKASGSACPGSEARHKMKKLTPKQKFSEDLESYKISVVMQESAEKLSEKLHKCKEFVDSCRLTFPTSGDEYSRGFLQNLNLIQDQNAQTRWKQGRYDEDGKPFNQRSLLLGHERILTRAKSYECSECGKVIRRKAWFDQHQRIHFLENPFECKVCGQAFRQRSALTV

SEQ ID NO: 858422 - protein, 74 aa, Homo sapiens
SLSVSYFKNCSYLYQLLFQELLSFEDVAMYFTREEWGHLNWGQKDLYRDVMLENYRNMVLLGRTRLEDWALSVF

SEQ ID NO: 858423 - protein, 87 aa, Homo sapiens
PARGSEAARVVVSVPPVRGDSPRGADQTDLGSGPGTPRGEPSPWWRRLGGDSEPSAAQPDVQDPTPCKRPGRGSHVPTSQGEGAALV

SEQ ID NO: 858424 - protein, 110 aa, Homo sapiens
TCSNTKHRDFVLSFVCVPRWNSGSQICQPRELQIRAGLTDFFSSPAQPDVQDPTPCKRPGRGSHVPTSQGEGELCLPLCFISIVTATSSSFLRLSPLDQCGEFSFLDSAM

SEQ ID NO: 858425 - protein, 229 aa, Homo sapiens
MLQYHCAERLWHIHLGCNCTLGYISKSEMTTAKGFQFPKPEMICQLENWDEQWILDLPRTGNRKASGSACPGSEARHKMKKLTPKQKFSEDLESYKISVVMQESAEKLSEKLHKCKEFVDSCRLTFPTSGDEYSRGFLQNLNLIQDQNAQTRWKQGRYDEDGKPFNQRSLLLGHERILTRAKSYECSECGKVIRRKAWFDQHQRIHFLENPFECKVCGQAFRQRSALTV

SEQ ID NO: 858426 - protein, 174 aa, Homo sapiens
SSAVDRSFTSFLVIWLGSEARHKMKKLTPKQKFSEDLESYKISVVMQESAEKLSEKLHKCKEFVDSCRLTFPTSGDEYSRGFLQNLNLIQDQNAQTRWKQGRYDEDGKPFNQRSLLLGHERILTRAKSYECSECGKVIRRKAWFDQHQRIHFLENPFECKVCGQAFRQRSALTV

SEQ ID NO: 858427 - protein, 138 aa, Homo sapiens
MFPPARGKELLSFEDVAMYFTREEWGHLNWGQKDLYRDVMLENYRNMVLLGFQFPKPEMICQLENWDEQWILDLPRTGNRKASGSACPGGLSLCRQAVFSLLSSLDYRRAPPCPATFCILVEMGFHHVGQAGLELLTS

SEQ ID NO: 858428 - protein, 530 aa, Homo sapiens
MATPDVSVHMEEVVVVTTPDTAVDGSGVEGVKTVLVTTNLAPHGGDLTEDNMETENAAAAAAAAFTASSQLKEAVLVKMAEEGENLEAEIVYPITCGDSRANLIWRKFVCPGINVKCVQYDEHVISPKEFVHLAGKSTLKDWKRAIRMNGIMLRKIMDSGELDFYQHDKVCSNTCRSTKIDLSGARVSLSSPTSAEYIPLTPAAADVNGSPATITIETCEDPGDWTAAIGDDTFTFWRGLKDAGLLDEVIQEFHQELVETMRGLQQRVQDPPLQLRDAVLLNNIVQNFGMLDLVKKVLASHKCQMDRSREQYARDLAALEQQCDEHRRRAKELKHKSQHLSNVLMTLTPVSLPPPVKRPRLARATSGPAAMASQVLTQSAQLALGPGVPVPQLTSVPLGKVVSTLPSTVLGKGSLQAPPASSPASPLLGGYTVLASSGSTYPSTVEIHPDASSLTVLSTAAVQDGSTVFKVVSPLQLLTLPGLGPTLQNVAQASPGSSTIVTVPAGAAPGPEEHTATIEVAAMAEDHERK

SEQ ID NO: 858429 - protein, 530 aa, Homo sapiens; identical to SEQ ID NO: 858428

SEQ ID NO: 858430 - protein, 530 aa, Homo sapiens; identical to SEQ ID NO: 858428

SEQ ID NO: 858431 - protein, 103 aa, Homo sapiens
GRVGRPTRPAVCGCPETWPWTHKEDQAEAPPGQGPGAGISGSSQPRPPAVSNRACPGRTLSARFPWTLLLILSAVEGPSEAPQCEGPVSHFTAPKGTGWLSVQ

SEQ ID NO: 858432 - protein, 530 aa, Homo sapiens; identical to SEQ ID NO: 858428

SEQ ID NO: 858433 - protein, 507 aa, Homo sapiens
CPAGCALRDPDSILSSLHFTRGDLTEDNMETENAAAAAAAAFTASSQLKEAVLVKMAEEGENLEAEIVYPITCGDSRANLIWRKFVCPGINVKCVQYDEHVISPKEFVHLAGKSTLKDWKRAIRMNGIMLRKIMDSGELDFYQHDKVCSNTCRSTKIDLSGARVSLSSPTSAEYIPLTPAAADVNGSPATITIETCEDPGDWTAAIGDDTFTFWRGLKDAGLLDEVIQEFHQELVETMRGLQQRVQDPPLQLRDAVLLNNIVQNFGMLDLVKKVLASHKCQMDRSREQYARDLAALEQQCDEHRRRAKELKHKSQHLSNVLMTLTPVSLPPPVKRPRLARATSGPAAMASQVLTQSAQLALGPGVPVPQLTSVPLGKVVSTLPSTVLGKGSLQAPPASSPASPLLGGYTVLASSGSTYPSTVEIHPDASSLTVLSTAAVQDGSTVFKVVSPLQLLTLPGLGPTLQNVAQASPGSSTIVTVPAGAAPGPEEHTATIEVAAMAEDHERK

SEQ ID NO: 858434 - protein, 165 aa, Homo sapiens [sequence omitted]

SEQ ID NO: 858435 - protein, 530 aa, Homo sapiens; identical to SEQ ID NO: 858428

SEQ ID NO: 858436 - protein, 530 aa, Homo sapiens; identical to SEQ ID NO: 858428

SEQ ID NO: 858437 - protein, 149 aa, Homo sapiens
MWSTEIRACTREAHTGVCVLGCSPHGPRSSDPVPPTSPFLPPCSVGLAPPAVILITAFHPRELITDPGQGSPTKTSIMSVTRARNWPQLGELQRGSSSGPEQLPGVRGGSAWCSALFCGCLNSLLPLHSVQPPNTECPLCTRYFVEAVR

SEQ ID NO: 858438 - protein, 189 aa, Homo sapiens
QTQIKDPKTPPQPGHQPAPRQGASRGRSLRARCAGRSQTPALCSLQQGEELGTEGGEKGGGVGGKRTRPRPARQAPAGEEGGGEPSWRNETLLKTENRANQGLQTGMWTRSKTKQNRTKKGGGTGRKNRRGERDRGKGRRIFFSSSHFFKKPTQENTHTHNQRLFPSRNINRAESNTLFFSLPKKKKKK

SEQ ID NO: 858439 - protein, 189 aa, Homo sapiens; identical to SEQ ID NO: 858438

SEQ ID NO: 858440 - protein, 470 aa, Homo sapiens
GGDRGRGRRRRPGERRRRSREPGAGWPALLLLAGDFPAWALTPRTSLRPSRTMGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGLLGDLASSDVAVELPFTLMHPKPKEEPPHREVPENETPVDTNLIELDTNDDDIVFEDFARQRLKGMKDDKEEEEDGTGSPQLNNR

SEQ ID NO: 858441 - protein, 470 aa, Homo sapiens; identical to SEQ ID NO: 858440

SEQ ID NO: 858442 - protein, 470 aa, Homo sapiens; identical to SEQ ID NO: 858440

SEQ ID NO: 858443 - protein, 470 aa, Homo sapiens; identical to SEQ ID NO: 858440

SEQ ID NO: 858444 - protein, 505 aa, Homo sapiens
MPGFSSLELRKLALGDSRSLPCKDLTARRLLRSPGELYWLSWRLTSGDGKSGLHGHCSDLKPAWCLSVTPALVPSPASRWPAGACPWAGYANPGLTSLSLHRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGDVAVELPFTLMHPKPKEEPPHREVPENETPVDTNLIELDTNDDDIVFEDFARQRLKGMKDDKEEEEDGTGSPQLNNR

SEQ ID NO: 858445 - protein, 156 aa, Homo sapiens
MEEADDTVAPSSTFCKVYTLTPFLANNREKRGLALDGKLKHEDTNLASSTLLREGANREILGIIVSYKVKVKLVVSRGGDVAVELPFTLMHPKPKEEPPHREVPENETPVDTNLIELDTNDDDIVFEDFARQRLKGMKDDKEEEEDGTGSPQLNNR

SEQ ID NO: 858446 - protein, 459 aa, Homo sapiens
GGDRGRGRRRRPGERRRRSREPGAGWPALLLLAGDFPAWALTPRTSLRPSRTMGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGGQAWRGRGCEEACMAQAVTSTWLKVMTLRRVSLQLFTRPSGKQGSRSFSSVSMCSVVVPSLEPPDFSSPDAHCR

SEQ ID NO: 858447 - protein, 97 aa, Homo sapiens
QACMVPVSHSSPGPQSCLKVARRSLPLGRIREPWPDLSFSPQSVQEGQSKWKGESVTAAPSASLTSHSGHFLLGSRGNGMSPEMHTSVGGGRCCSPS

SEQ ID NO: 858448 - protein, 225 aa, Homo sapiens
GGDRGRGRRRRPGERRRRSREPGAGWPALLLLAGDFPAWALTPRTSLRPSRTMGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCRPGGEILGREERFQQREILVRSG

SEQ ID NO: 858449 - protein, 462 aa, Homo sapiens
GGDRGRGRRRRPGERRRRSREPGAGWPALLLLAGDFPAWALTPRTSLRPSRTMGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGDVAVELPFTLMHPKPKEEPPHREVPENETPVDTNLIELDTNDDDIVFEDFARQRLKGMKDDKEEEEDGTGSPQLNNR

SEQ ID NO: 858450 - protein, 470 aa, Homo sapiens; identical to SEQ ID NO: 858440

SEQ ID NO: 858451 - protein, 405 aa, Homo sapiens
MGVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGDVAVELPFTLMHPKPKEEPPHREVPENETPVDTNLIELDTNDDDIVFEDFARQRLKGMKDDKEEEEDGTGSPQLNNR

SEQ ID NO: 858452 - protein, 348 aa, Homo sapiens
MGFLSSGAGGNDCTLATNRSLRKVGPRTIQVLPAKRKAQVSLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGDVAVELPFTLMHPKPKEEPPHREVPENETPVDTNLIELDTNDDDIVFEDFARQRLKGMKDDKEEEEDGTGSPQLNNR

SEQ ID NO: 858453 - protein, 112 aa, Homo sapiens
GPSPDVTVPTATGGIHMCQPDRPFCSWSAPEARDLREGGSPRPQSHTLSHIWPGLWISLLSLPLQTHHIFLVSPTSDDDIVFEDFARQRLKGMKDDKEEEEDGTGSPQLNNR

SEQ ID NO: 858454 - protein, 647 aa, Homo sapiens
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEVSWDRLKRVWRRPKTPLRTSTGGISTLGLQELKEQSPCPSLGRAEGGGVSSLLPNHHHPHGPPGGLFEDFAC

SEQ ID NO: 858455 - protein, 296 aa, Homo sapiens
MGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPGNETICPPNIYIECADHTLDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEARALEKAGWEWGPWAKQKGAVRGAWWSWPGWKVRFRVLCQGPLTGWQA

SEQ ID NO: 858456 - protein, 528 aa, Homo sapiens
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPGNETICPPNIYIECADHTLGPCCLPFPTSPSASSCLCPLFSSLSWILPSQSLPGGFFLGVEP

SEQ ID NO: 858457 - protein, 528 aa, Homo sapiens; identical to SEQ ID NO: 858456

SEQ ID NO: 858458 - protein, 666 aa, Homo sapiens
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPGNETICPPNIYIECADHTLDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEVSWDRLKRVWRRPKTPLRTSTGGISTLGLQELKEQSPCPSLGRAEGGGVSSLLPNHHHPHGPPGGLFEDFAC

SEQ ID NO: 858459 - protein, 182 aa, Homo sapiens
MGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPGNETICPPNIYIECADHTLGPCCLPFPTSPSASSCLCPLFSSLSWILPSQSLPGGFFLGVEP

SEQ ID NO: 858460 - protein, 192 aa, Homo sapiens
MTSIPFPGDRLLQVDGVILCGLTHKQAVQCLKGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWADT

SEQ ID NO: 858461 - protein, 133 aa, Homo sapiens
MGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWADT

SEQ ID NO: 858462 - protein, 129 aa, Homo sapiens [sequence omitted]

SEQ ID NO: 858463 - protein, 234 aa, Homo sapiens
MAFLAGPRLLDWASSPPHLQFNKFVLTGYRPASSGSGCLRSLFYLHNELGNIYTHGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 858464 - protein, 337 aa, Homo sapiens
MAFLAGPRLLDWASSPPHLQFNKFVLTGYRPASSGSGCLRSLFYLHNELGNIYTHGLALLGFLVLVPMTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPTMKYSYFLIKKKTLFQCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 858465 - protein, 204 aa, Homo sapiens
MPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 858466 - protein, 273 aa, Homo sapiens
MAFLAGPRLLDWASSPPHLQFNKFVLTGYRPASSGSGCLRSLFYLHNELGNIYTHGLALLGFLVLVPMTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 858467 - protein, 273 aa, Homo sapiens; identical to SEQ ID NO: 858466

SEQ ID NO: 858468 - protein, 273 aa, Homo sapiens; identical to SEQ ID NO: 858466

SEQ ID NO: 858469 - protein, 273 aa, Homo sapiens; identical to SEQ ID NO: 858466

SEQ ID NO: 858470 - protein, 273 aa, Homo sapiens; identical to SEQ ID NO: 858466

SEQ ID NO: 858471 - protein, 270 aa, Homo sapiens
GAWAEPGVPSRVRPRPSSWLQRDYRPPPPPPPRAVPAARLPWRSRPQCAQASGLALLGFLVLVPMTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 858472 - protein, 206 aa, Homo sapiens
MAFLAGPRLLDWASSPPHLQFNKFVLTGYRPASSGSGCLRSLFYLHNELGNIYTHGLALLGFLVLVPMTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLLHAGVVPDLLWAAHHACPRD

SEQ ID NO: 858473 - protein, 272 aa, Homo sapiens
MAFLAGPRLLDWASSPPHLQFNKFVLTGYRPASSGSGCLRSLFYLHNELGNIYTHGLALLGFLVLVPMTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYVVQVTQPGIIDNHRIEADGASNTLQCIANKTWQSGCH

SEQ ID NO: 858474 - protein, 273 aa, Homo sapiens; identical to SEQ ID NO: 858466

SEQ ID NO: 858475 - protein, 171 aa, Homo sapiens
MAEDEPDAKSPKTGGRAPPGGAEAGEPTTLLQRLRGTISKAVQNKVEGIRKMAEVEQKKKRTFRKFTYRGVDLDQLLDMSYEQLMQLYSARQRRRLNRGLRRKQHSLLKRLRKAKKEAPPMGEAGSGETHLRDMIILPEMVGSNGGASTTEDFNRWRSSRMIGHYLGDSHH

SEQ ID NO: 858476 - protein, 616 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLKEHVLQSSLSQEHKDPKATPP

SEQ ID NO: 858477 - protein, 616 aa, Homo sapiens; identical to SEQ ID NO: 858476

SEQ ID NO: 858478 - protein, 679 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRWVEGWVVEMSGLVGIGPLTHEELPALIKPAFLKGSSHLILGTLRAYPWPPSLSIFPLCSPLTQKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLKEHVLQSSLSQEHKDPKATPP

SEQ ID NO: 858479 - protein, 616 aa, Homo sapiens; identical to SEQ ID NO: 858476

SEQ ID NO: 858480 - protein, 370 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAAWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLKEHVLQSSLSQEHKDPKATPP

SEQ ID NO: 858481 - protein, 183 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLLLPLTFSA

SEQ ID NO: 858482 - protein, 203 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPALLPLTFSA

SEQ ID NO: 858483 - protein, 183 aa, Homo sapiens; identical to SEQ ID NO: 858481

SEQ ID NO: 858484 - protein, 160 aa, Homo sapiens [sequence omitted]

SEQ ID NO: 858485 - protein, 616 aa, Homo sapiens; identical to SEQ ID NO: 858476

SEQ ID NO: 858486 - protein, 527 aa, Homo sapiens
MYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLKEHVLQSSLSQEHKDPKATPP

SEQ ID NO: 858487 - protein, 616 aa, Homo sapiens; identical to SEQ ID NO: 858476

SEQ ID NO: 858488 - protein, 616 aa, Homo sapiens; identical to SEQ ID NO: 858476

SEQ ID NO: 858489 - protein, 602 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPKEVHSPLYRQLSHPVYLVPGCCL

SEQ ID NO: 858490 - protein, 407 aa, Homo sapiens
AAVGAGHGAGGPGAASSSGGAREGARVAALCLLWYALSAGGNVVNKVILSAFPFPVTVSLCHILALCAGLPPLLRAWRVPPAPPVSGPGPSPHPSSGPLLPPRFYPRYVLPLAFGKYFASVSAHVSIWKVPVSYAHTVKATMPIWVVLLSRIIMKEKQSTKVYLSLIPIISGVLLATVTELSFDMWGLVSALAATLCFSLQNIFSKKVLRDSRIHHLRLLNILGCHAVFFMIPTWVLVDLSAFLVSSDLTYVYQWPWTLLLLAVSGFCNFAQNVIAFSILNLVSPLSYSVANATKRIMVITVSLIMLRNPVTSTNVLGMMTAILGVFLYNKTKYDANQQARKHLLPVTTADLSSKERHRSPLEKPHNGLLFPQHGDYQYGRNNILTDHFQYSRQSYPNSYSLNRYDV

SEQ ID NO: 858491 - protein, 407 aa, Homo sapiens; identical to SEQ ID NO: 858490

SEQ ID NO: 858492 - protein, 407 aa, Homo sapiens; identical to SEQ ID NO: 858490

SEQ ID NO: 858493 - protein, 407 aa, Homo sapiens; identical to SEQ ID NO: 858490

SEQ ID NO: 858494 - protein, 407 aa, Homo sapiens; identical to SEQ ID NO: 858490

SEQ ID NO: 858495 - protein, 180 aa, Homo sapiens
MPAFTLCTSHPRAAVSPPSGLQTYVYQWPWTLLLLAVSGFCNFAQNVIAFSILNLVSPLSYSVANATKRIMVITVSLIMLRNPVTSTNVLGMMTAILGVFLYNKTKYDANQQARKHLLPVTTADLSSKERHRSPLEKPHNGLLFPQHGDYQYGRNNILTDHFQYSRQSYPNSYSLNRYDV

SEQ ID NO: 858496 - protein, 407 aa, Homo sapiens; identical to SEQ ID NO: 858490

SEQ ID NO: 858497 - protein, 262 aa, Homo sapiens
AAVGAGHGAGGPGAASSSGGAREGARVAALCLLWYALSAGGNVVNKVILSAFPFPVTVSLCHILALCAGLPPLLRAWRVPPAPPVSGPGPSPHPSSGPLLPPRFYPRYVLPLAFGKYFASVSAHVSIWKVPVSYAHTVKATMPIWVVLLSRIIMKEKQSTKVYLSLIPIISGVLLATVTELSFDMWGLVSALAATLCFSLQNIFSKKVLRDSRIHHLRLLNILGCHAVFFMIPTWVLVDLSAFLVSSDLVSCTAPRTRHFLG

SEQ ID NO: 858498 - protein, 151 aa, Homo sapiens
AGGPGAASSSGGAREGARVAALCLLWYALSAGGNVVNKVILSAFPFPVTVSLCHILALCAGLPPLLRAWRVPPAPPVSGPGPSPHPSSGPLLPPRFYPRYVLPLAFGKYFASVSAHVSIWKVPVSYAHTGRFRARPRGRRPGPPLRVWAHG

SEQ ID NO: 858499 - protein, 215 aa, Homo sapiens
AAVGAGHGAGGPGAASSSGGAREGARVAALCLLWYALSAGGNVVNKVILSAFPFPVTVSLCHILALCAGLPPLLRAWRVPPAPPVSGPGPSPHPSSGPLLPPRFYPRYVLPLAFGKYFASVSAHVSIWKVPVSYAHTVKATMPIWVVLLSRIIMKEKQSTKVTPGRDSGQMGAPGGSSLLPTGDVVRILVCRLPGFPSNREVSVEVSSGLLLLKF

SEQ ID NO: 858500 - protein, 407 aa, Homo sapiens; identical to SEQ ID NO: 858490

SEQ ID NO: 858501 - protein, 407 aa, Homo sapiens; identical to SEQ ID NO: 858490

SEQ ID NO: 858502 - protein, 407 aa, Homo sapiens; identical to SEQ ID NO: 858490

SEQ ID NO: 858503 - protein, 321 aa, Homo sapiens
MGMGLPTNKPCPWRSDNHLPPATHQSVTGTANTTFKVLGGIPLLREERGSSLGICGMWPSSSLACEPFSDDLFLQVYLSLIPIISGVLLATVTELSFDMWGLVSALAATLCFSLQNIFSKKVLRDSRIHHLRLLNILGCHAVFFMIPTWVLVDLSAFLVSSDLTYVYQWPWTLLLLAVSGFCNFAQNVIAFSILNLVSPLSYSVANATKRIMVITVSLIMLRNPVTSTNVLGMMTAILGVFLYNKTKYDANQQARKHLLPVTTADLSSKERHRSPLEKPHNGLLFPQHGDYQYGRNNILTDHFQYSRQSYPNSYSLNRYDV

SEQ ID NO: 858504 - protein, 407 aa, Homo sapiens; identical to SEQ ID NO: 858490

SEQ ID NO: 858505 - protein, 262 aa, Homo sapiens; identical to SEQ ID NO: 858497

SEQ ID NO: 858506 - protein, 222 aa, Homo sapiens
QRFILLDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVYSVESTLYTSEKLQMKEMTCRDIVKEVAKIIYIVHDEVKDKAFELELSWVGELTNGRHEIVPKDIREEAEKYAKESLKEEDESDDDNM

SEQ ID NO: 858507 - protein, 259 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 858508 - protein, 259 aa, Homo sapiens; identical to SEQ ID NO: 858507

SEQ ID NO: 858509 - protein, 259 aa, Homo sapiens; identical to SEQ ID NO: 858507

SEQ ID NO: 858510 - protein, 281 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKVSHSTKTSLGQVQSGNHLAQEFETSLSSTARPPSLI

SEQ ID NO: 858511 - protein, 283 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKVSHSTKTSLGQVQSGNHLAQEFETSVGGSPEVRSSRPA

SEQ ID NO: 858512 - protein, 233 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGECKLFLYIYLP

SEQ ID NO: 858513 - protein, 142 aa, Homo sapiens
MYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 858514 - protein, 223 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGE

SEQ ID NO: 858515 - protein, 116 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKSKLITY

SEQ ID NO: 858516 - protein, 119 aa, Homo sapiens
MLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 858517 - protein, 208 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKISAVVVNY

SEQ ID NO: 858518 - protein, 154 aa, Homo sapiens
WSKCYILSSSDSSSSFRDSLAYFSASSVDLFWLQFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 858519 - protein, 194 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRKS

SEQ ID NO: 858520 - protein, 119 aa, Homo sapiens; identical to SEQ ID NO: 858516

SEQ ID NO: 858521 - protein, 193 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCRIYIVHDEVKDKAFELELSWVGELTNGRHEIVPKDIREEAEKYAKESLKEEDESDDDNM

SEQ ID NO: 858522 - protein, 134 aa, Homo sapiens
QRFILLDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEV

SEQ ID NO: 858523 - protein, 259 aa, Homo sapiens; identical to SEQ ID NO: 858507

SEQ ID NO: 858524 - protein, 159 aa, Homo sapiens
SNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 858525 - protein, 90 aa, Homo sapiens
GLQEFGTRDYIHINIGALELSANHNILHIVVCVMTYKRKTKKKKKKKKIKSRKTITNGRHEIVPKDIREEAEKYAKESLKEEDESDDDNM

SEQ ID NO: 858526 - protein, 259 aa, Homo sapiens; identical to SEQ ID NO: 858507

SEQ ID NO: 858527 - protein, 269 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNMHKHSKRGSLE

SEQ ID NO: 858528 - protein, 281 aa, Homo sapiens; identical to SEQ ID NO: 858510

SEQ ID NO: 858529 - protein, 247 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKNL

SEQ ID NO: 858530 - protein, 184 aa, Homo sapiens
MAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 858531 - protein, 233 aa, Homo sapiens; identical to SEQ ID NO: 858512

SEQ ID NO: 858532 - protein, 241 aa, Homo sapiens
MSSIGTGYDLSASTFSPDGRVFQVEYAMKAVENSSTAIGIRCKDGVVFGVEKLVLSKLYEEGSNADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 858533 - protein, 248 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 858534 - protein, 203 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQMKEMTCRDIVKEVAKIVS

SEQ ID NO: 858535 - protein, 184 aa, Homo sapiens; identical to SEQ ID NO: 858530

SEQ ID NO: 858536 - protein, 190 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFWLQFMLGSYSVNDGAQLYMIDPSGVSYGYWGCAIGKARQAAKTEIEKLQVIINA

SEQ ID NO: 858537 - protein, 135 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCR

SEQ ID NO: 858538 - protein, 1059 aa, Homo sapiens
APPREVSGSWFCFLRPRSPPLHPSRLPLRSGPEPSRLRCHSSRLHTLADAHTLSLPVPPPPPQLLDLWVCFITPGASPADSAARYLSSARSPLAGSGEQRRRGWGGEGKGRGWKLPGAVSPRRCWCCRCLLLLRRRRRRRRLLRLFARPLSASMCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 858539 - protein, 887 aa, Homo sapiens
SRRNYGKWKLDGMFLLRRYVCIFTEKLKNQAELYVFLSVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 858540 - protein, 1041 aa, Homo sapiens
APPREVSGSWFCFLRPRSPPLHPSRLPLRSGPEPSRLRCHSSRLHTLADAHTLSLPVPPPPPQLLDLWVCFITPGASPADSAARYLSSARSPLAGSGEQRRRGWGGEGKGRGWKLPGAVSPRRCWCCRCLLLLRRRRRRRRLLRLFARPLSASMCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 858541 - protein, 1059 aa, Homo sapiens; identical to SEQ ID NO: 858538

SEQ ID NO: 858542 - protein, 1001 aa, Homo sapiens
APPREVSGSWFCFLRPRSPPLHPSRLPLRSGPEPSRLRCHSSRLHTLADAHTLSLPVPPPPPQLLDLWVCFITPGASPADSAARYLSSARSPLAGSGEQRRRGWGGEGKGRGWKLPGAVSPRRCWCCRCLLLLRRRRRRRRLLRLFARPLSASMCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEKTWPIQSLHL

SEQ ID NO: 858543 - protein, 541 aa, Homo sapiens
APPREVSGSWFCFLRPRSPPLHPSRLPLRSGPEPSRLRCHSSRLHTLADAHTLSLPVPPPPPQLLDLWVCFITPGASPADSAARYLSSARSPLAGSGEQRRRGWGGEGKGRGWKLPGAVSPRRCWCCRCLLLLRRRRRRRRLLRLFARPLSASMCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTVL

SEQ ID NO: 858544 - protein, 191 aa, Homo sapiens
MCNTQRMKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHVRFQPADN

SEQ ID NO: 858545 - protein, 177 aa, Homo sapiens
RGAEKRPSAPTQRRRGVAGLLLFVGAARTTRSALPAALSPASSSRRAALERGPGGSKTTSPKPRVAELLGSAIRSTSTSTSSTGQGPRRCIPRGFRCAPGRSRAACAATAAASTHSQTLTRSPSLFPRPLPSSLISGSVLLLLVRVPRTPRPAICHQLALHWRGAESSEEGGGEGRG

SEQ ID NO: 858546 - protein, 773 aa, Homo sapiens
KNVLAASSIYFKSLVLHDNLINLDTDMVSSTVFQQILDFIYTGKLLPSDQPAEPNFSTLLTAASYLQLPELAALCRRKLKRAGKPFGSGRAGSTGMGRPPRSQRLSTASVIQARYQGLVDGRKGAHAPQELPQAKGSDDELFLGGSNQDSVQGLGRAVCPAGGEAGLGGCSSSTNGSSGGCEQELGLDLSKKSPPLPPATPGPHLTPDDAAQLSDSQHGSPPAASAPPVANSASYSELGGTPDEPMDLEGAEDNHLSLLEAPGGQPRKSLRHSTRKKEWGKKEPVAGSPFERREAGPKGPCPGEEGEGVGDRVPNGILASGAGPSGPYGEPPYPCKEEEENGKDASEDSAQSGSEGGSGHASAHYMYRQEGYETVSYGDNLYVCIPCAKGFPSSEQLNAHVETHTEEELFIKEEGAYETGSGGAEEEAEDLSAPSAAYTAEPRPFKCSVCEKTYKDPATLRQHEKTHWLTRPFPCNICGKMFTQRGTMTRHMRSHLGLKPFACDECGMRFTRQYRLTEHMRVHSGEKPYECQLCGGKFTQQRNLISHLRMHTSPSKKPKTRGRPLPPCSPGTHGRRSEVMQQQGQDPGSSGGSGWPLWPPLPTPRALMDSPYQAEPRGGKPGVPARLPPHPTQAPSSPRGPPQGLWAGSRGSRWDLVPLLQAAWRKGSGTLATARVVSGAGLTPLAVSVCVHVCLCLCGRVQPWFCREKVLGVQIPPSLSQGGTVHWRWDSQGDPTAYLSTTKEPSGPVLLLFLLICSSVFLFDFCFLNQNRQ

SEQ ID NO: 858547 - protein, 773 aa, Homo sapiens; identical to SEQ ID NO: 858546

SEQ ID NO: 858548 - protein, 773 aa, Homo sapiens; identical to SEQ ID NO: 858546

SEQ ID NO: 858549 - protein, 69 aa, Homo sapiens
MIAAILWRGGLVFICVCVRVCVCMCVCVCLCVVCAVCMGRCFAFPPSSLNKVETSDLLLPLEFMTTICW

SEQ ID NO: 858550 - protein, 247 aa, Homo sapiens
LVVPGGGAWPQYKKQNKKFYGDPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMASRQPISAPLFSCPDKNKVNFIPTGSAFCPVKLLGPLLPASDLMLKNSPNSGQSSALATLTVEQLSSRVSFTSLSDDTSTAGSMEASVQQPSQQQQLLQELQGEDHISAQNYVII

SEQ ID NO: 858551 - protein, 104 aa, Homo sapiens
KLAAAAPAEQAPRAKGRPRRSPESHRRSSSPERRSPGSPVCRGSEPNPPVLPGCVSPTVPSVETSASSGFSLLVHYRRCESGFGNLTPLRSLWGLEERTEKRLL

SEQ ID NO: 858552 - protein, 137 aa, Homo sapiens
MFHFFRKPPESKKPSVPETEADGFVLLGDTTDEQRMTARGKTSDIEANQPLETNKENSSSVTVSDPEMENKAGQTLENSSLMAELLSDVPFTLAPHVLAVQGTITDLPDHLLSYDGSENLSRFWYDFTLENSVLCDS

SEQ ID NO: 858553 - protein, 137 aa, Homo sapiens; identical to SEQ ID NO: 858552

SEQ ID NO: 858554 - protein, 137 aa, Homo sapiens; identical to SEQ ID NO: 858552

SEQ ID NO: 858555 - protein, 137 aa, Homo sapiens; identical to SEQ ID NO: 858552

SEQ ID NO: 858556 - protein, 437 aa, Homo sapiens
KLAAAAPAEQAPRAKGRPRRSPESHRRSSSPERRSPGSPVCRADKAKSQQVRTSSTIRRTSSLDTITGPYLTGQWPRDPHVHYPSCMKDKATQTPSCWAEEGAEKRSHQRSASWGSADQLKEQIAKLRQQLQRSKQSSRHSKEKDRQSPLHGNHITISHTQATGSRSVPMPLSNISVPKSSVSRVPCNVEGISPELEKVFIKENNGKEEVSKPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMASRQPISAPLFSCPDKNKVNFIPTGSAFCPVKLLGPLLPASDLMLKNSPNSGQSSALATLTVEQLSSRVSFTSLSDDTSTAGSMEASVQQPSQQQQLLQELQGEDHISAQNYVII

SEQ ID NO: 858557 - protein, 494 aa, Homo sapiens
MFHFFRKPPESKKPSVPETEADGFVLLGDTTDEQRMTARGKTSDIEANQPLETESCTGTQAGVQWRNLGSLQAPPPGFTPCSCLSLPSSWDYRRPPPWPADKAKSQQVRTSSTIRRTSSLDTITGPYLTGQWPRDPHVHYPSCMKDKATQTPSCWAEEGAEKRSHQRSASWGSADQLKEQIAKLRQQLQRSKQSSRHSKEKDRQSPLHGNHITISHTQATGSRSVPMPLSNISVPKSSVSRVPCNVEGISPELEKVFIKENNGKEEVSKPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMASRQPISAPLFSCPDKNKVNFIPTGSAFCPVKLLGPLLPASDLMLKNSPNSGQSSALATLTVEQLSSRVSFTSLSDDTSTAGSMEASVQQPSQQQQLLQELQGEDHISAQNYVII

SEQ ID NO: 858558 - protein, 470 aa, Homo sapiens
MFIAALFTIAKTWNQPKCPSVIDWIKKMWHIYTMEYYAAIKKNEFMTFARMWMKLETIILSKLSARTKHCMSSLIADKAKSQQVRTSSTIRRTSSLDTITGPYLTGQWPRDPHVHYPSCMKDKATQTPSCWAEEGAEKRSHQRSASWGSADQLKEQIAKLRQQLQRSKQSSRHSKEKDRQSPLHGNHITISHTQATGSRSVPMPLSNISVPKSSVSRVPCNVEGISPELEKVFIKENNGKEEVSKPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMASRQPISAPLFSCPDKNKVNFIPTGSAFCPVKLLGPLLPASDLMLKNSPNSGQSSALATLTVEQLSSRVSFTSLSDDTSTAGSMEASVQQPSQQQQLLQELQGEDHISAQNYVII

SEQ ID NO: 858559 - protein, 154 aa, Homo sapiens
KLAAAAPAEQAPRAKGRPRRSPESHRRSSSPERRSPGSPVCRADKAKSQQVRTSSTIRRTSSLDTITGPYLTGQWPRDPHVHYPSCMKDKATQTPSCWAEEGAEKRSHQRSASWGSADQLKERQGLIMLPRLVSNSWAQAVLPPQPPKVLESQV

SEQ ID NO: 858560 - protein, 75 aa, Homo sapiens
RFLGDLGVVSNLSLAHLVTRSRRPCQEYSRMSAHKNTFKRYGGNWTEVLIGYYNVVETESVNWPKATELSSFKFP

SEQ ID NO: 858561 - protein, 140 aa, Homo sapiens
KLAAAAPAEQAPRAKGRPRRSPESHRRSSSPERRSPGSPVCRADKAKSQQVRTSSTIRRTSSLDTITGPYLTGQWPRDPHVHYPSCMKDKATQTPSCWAEEGAEKRSHQRSASWGSADQLKEVSYFCFPSVTCFGPSRLP

SEQ ID NO: 858562 - protein, 118 aa, Homo sapiens
KLAAAAPAEQAPRAKGRPRRSPESHRRSSSPERRSPGSPVCRADKAKSQQVRTSSTIRRTSSLDTITGPYLTGQWPRDPHVHYPSCMKDKATQVKSGNQNQLITLHFFCFDHSKENVI

SEQ ID NO: 858563 - protein, 137 aa, Homo sapiens; identical to SEQ ID NO: 858552

SEQ ID NO: 858564 - protein, 227 aa, Homo sapiens
QLVPALRLWIGSWGVKLRVLDAARGLLGPASVLARTQTAAAAAAAAAAAAAAAAMFHFFRKPPESKKPSVPETEADGFVLLEASQRLSSDVLLKVLTLGQTLWVGFVAPRLTLYSLAGDTTDEQRMTARGKTSDIEANQPLETNKENSSSVTVSDPEMENKAGQTLENSSLMAELLSDVPFTLAPHVLAVQGTITDLPDHLLSYDGSENLSRFWYDFTLENSVLCDS

SEQ ID NO: 858565 - protein, 137 aa, Homo sapiens; identical to SEQ ID NO: 858552

SEQ ID NO: 858566 - protein, 386 aa, Homo sapiens
KLAAAAPAEQAPRAKGRPRRSPESHRRSSSPERRSPGSPVCRADKAKSQQVRTSSTIRRTSSLDTITGPYLTGQWPRDPHVHYPSCMKDKATQTPSCWAEEGAEKRSHQRSASWGSADQLKEQIAKLRQQLQRSKQSSRHSKEKDRQSPLHGNHITISHTQPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMASRQPISAPLFSCPDKNKVNFIPTGSAFCPVKLLGPLLPASDLMLKNSPNSGQSSALATLTVEQLSSRVSFTSLSDDTSTAGSMEASVQQPSQQQQLLQELQGEDHISAQNYVII

SEQ ID NO: 858567 - protein, 351 aa, Homo sapiens [sequence omitted]

SEQ ID NO: 858568 - protein, 408 aa, Homo sapiens
KLAAAAPAEQAPRAKGRPRRSPESHRRSSSPERRSPGSPVCRADKAKSQQVRTSSTIRRTSSLDTITGPYLTGQWPRDPHVHYPSCMKDKATQQIAKLRQQLQRSKQSSRHSKEKDRQSPLHGNHITISHTQATGSRSVPMPLSNISVPKSSVSRVPCNVEGISPELEKVFIKENNGKEEVSKPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMASRQPISAPLFSCPDKNKVNFIPTGSAFCPVKLLGPLLPASDLMLKNSPNSGQSSALATLTVEQLSSRVSFTSLSDDTSTAGSMEASVQQPSQQQQLLQELQGEDHISAQNYVII

SEQ ID NO: 858569 - protein, 201 aa, Homo sapiens
MFPEQQKEEFVSVWVRDPRIQKEDFWHSYIDYEICIHTNSMCFTMKTSCVRRRYREFVWLRQRLQSNALLVQLPELPSKNLFFNMNNRQHVDQRRQGLEDFLRKVLQNALLLSDSSLHLFLQSHLNSEDIEACVSGQTKYSVEEAIHKFALMNRRFPEEDEEGKKENDIDYDSESSSSGLGHSSDDSSSHGCKVNTAPQES

SEQ ID NO: 858570 - protein, 224 aa, Homo sapiens [sequence omitted]

SEQ ID NO: 858571 - protein, 201 aa, Homo sapiens; identical to SEQ ID NO: 858569

SEQ ID NO: 858572 - protein, 117 aa, Homo sapiens
MNNRQHVDQRRQGLEDFLRKVLQNALLLSDSSLHLFLQSHLNSEDIEACVSGQTKYSVEEAIHKFALMNRRFPEEDEEGKKENDIDYDSESSSSGLGHSSDDSSSHGCKVNTAPQES

SEQ ID NO: 858573 - protein, 201 aa, Homo sapiens; identical to SEQ ID NO: 858569

SEQ ID NO: 858574 - protein, 201 aa, Homo sapiens; identical to SEQ ID NO: 858569

SEQ ID NO: 858575 - protein, 161 aa, Homo sapiens
MCFTMKTSCVRRRYREFVWLRQRLQSNALLVQLPELPSKNLFFNMNNRQHVDQRRQGLEDFLRKVLQNALLLSDSSLHLFLQSHLNSEDIEACVSGQTKYSVEEAIHKFALMNRRFPEEDEEGKKENDIDYDSESSSSGLGHSSDDSSSHGCKVNTAPQES

SEQ ID NO: 858576 - protein, 201 aa, Homo sapiens; identical to SEQ ID NO: 858569

SEQ ID NO: 858577 - protein, 194 aa, Homo sapiens
FPVLLAVLKNISLFMMPLQEFVSVWVRDPRIQKEDFWHSYIDYEICIHTNSMCFTMKTSCVRRRYREFVWLRQRLQSNALLVQLPELPSKNLFFNMNNRQHVDQRRQGLEDFLRKVLQNALLLSDSSLHLFLQSHLNSEDIEACVSGQTKYSVEEAIHKFALMNRRFPEEDEEGKKDDDSSSHGCKVNTAPQES

SEQ ID NO: 858578 - protein, 270 aa, Homo sapiens [sequence omitted]

SEQ ID NO: 858579 - protein, 233 aa, Homo sapiens
MTQNTVIVNGVAMASRPSQPTHVNVHIHQESALTQLLKAGGSLKKFLFHPGDTVPSTARIGYEQLALGVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 858580 - protein, 321 aa, Homo sapiens
GGGAELQPLGFMTGCRAWGPSGVLLLREGHWALGSWEGPRADGPGKARGVVLASSPARPGPACKCARVGAQGARGGSVFSRPVRSSGRNPLCRAPGPQLVSGNRAAWAGPQPPPVHLPSPPSRRSPARGQLVSALLGRGLPEDCRQGLRGRETLLPQDPLSRGVPRAMPPPRPVHRTSFFLQPGFQEDSRRREGQLGAGVSPQKNGWRAGGEAWGWRVPSTFCRLHAWTLAGALRWGGSWDGARERRGCRTLSPAPGHGKSWTEESVRGSREEPTTYQASGGPQGNLRGAGLVQIRLFRRGRGRSRGWRGAGEAVVLGARR

SEQ ID NO: 858581 - protein, 270 aa, Homo sapiens [sequence omitted]

SEQ ID NO: 858582 - protein, 270 aa, Homo sapiens [sequence omitted]

SEQ ID NO: 858583 - protein, 270 aa, Homo sapiens [sequence omitted]

SEQ ID NO: 858584 - protein, 284 aa, Homo sapiens
HQTLPYNKTFKKSHYWKTKLQHLAYSSSCEVLLGFRGPSKPYQESALTQLLKAGGSLKKFLFHPGDTVPSTARIGYEQLALGVTQILLGVVSCVLGVCLSLGPWTVLRASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 858585 - protein, 274 aa, Homo sapiens
IAKPMRRVRGDPGQCCFMDFKGTESSRIRAAERSRQRKGEESHLGRSQAAGPRAAGACGLTGRGLVSHPVLQVTQILLGVVSCVLGVCLSLGPWTVLRASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 858586 - protein, 233 aa, Homo sapiens; identical to SEQ ID NO: 858579

SEQ ID NO: 858587 - protein, 209 aa, Homo sapiens
MTQNTVIVNGVAMASRPSQPTHVNVHIHQESALTQLLKAGGSLKKFLFHPGDTVPSTARIGYEQLALGVTQILLGVVSCVLGVCLSLGPWTVLRASGCAFWAGSVVIAAGAGAIVHEKHPGKLAGYISSLLTLAGFATAMAAVVLCVNSFIWQTEPFLYIDTVCDRSDQVVHSNPCPVPGCLCLEGHCVLGFLGSRSSKLVWPELPAPE

SEQ ID NO: 858588 - protein, 253 aa, Homo sapiens
MTQNTVIVNGVAMASRPSQPTHVNVHIHQESALTQLLKAGGSLKKFLFHPGDTVPSTARIGYEQLALGVTQILLGVVSCVLGVCLSLGPWTVLSASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRLNSKCGALVEGRAWPVRTVRVRLDTAEQATGWEEQSLERWGCATVRGFGFHAE

SEQ ID NO: 858589 - protein, 243 aa, Homo sapiens
MTQNTVIVNGVAMASRPSQPTHVNVHIHQESALTQLLKAGGSLKKFLFHPGDTVPSTARIGYEQLALGVTQILLGVVSCVLGVCLSLGPWTVLRASGCAFWAGSVVIAAGAGAIVHEKHPGKLAGYISSLLTLAGFATAMAAVVLCVNSFIWQTEPFLYIDTVCDRSDPPLPLSCEPPKTPRGARMSLSRAAQGPHSWLLTLASPMAALQTLLLSSPHIRTCCSHSGVLKSMNRYCCIFHNAD

SEQ ID NO: 858590 - protein, 270 aa, Homo sapiens [sequence omitted]

SEQ ID NO: 858591 - protein, 270 aa, Homo sapiens [sequence omitted]

SEQ ID NO: 858592 - protein, 102 aa, Homo sapiens
MTQNTVIVNGVAMASRPSQPTHVNVHIHQESALTQLLKAGGSLKKFLFHPGDTVPSTARIGYEQLALGDSDIAGVGGTSYPTASRSAGITGTSHHTRPNTQL

SEQ ID NO: 858593 - protein, 270 aa, Homo sapiens [sequence omitted]

SEQ ID NO: 858594 - protein, 286 aa, Homo sapiens
MTATELGSVSPNGEGRMTQNTVIVNGVAMASRPSQPTHVNVHIHQESALTQLLKAGGSLKKFLFHPGDTVPSTARIGYEQLALGVTQILLGVVSCVLGVCLSLGPWTVLSASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 858595 - protein, 131 aa, Homo sapiens
MAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 858596 - protein, 270 aa, Homo sapiens [sequence omitted]

SEQ ID NO: 858597 - protein, 210 aa, Homo sapiens
CFSGLFIMFNQHCGKCNNCVLGVCLSLGPWTVLRASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 858598 - protein, 296 aa, Homo sapiens
MTQNTVIVNGVAMASRPSQPTHVNVHIHQESALTQLLKAGGSLKKFLFHPGDTVPSTARIGYEQLALGVTQILLGVVSCVLGVCLSLGPWTVLRASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTLLLSSPHIRTCCSHSGVLKSMNRYCCIFHNAD

SEQ ID NO: 858599 - protein, 219 aa, Homo sapiens
MTQNTVIVNGVAMASRPSQPTHVNVHIHQESALTQLLKAGGSLKKFLFHPGDTVPSTARIGYEQLALGVTQILLGVVSCVLGVCLSLGPWTVLRASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKFYSKALTDSGRGGFKVSP

SEQ ID NO: 858600 - protein, 238 aa, Homo sapiens
MDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFDSGNSTYVKPSNERIVLLRQMPLKAV

SEQ ID NO: 858601 - protein, 211 aa, Homo sapiens
MDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRSWRRSNKTRTTCARRRASKIRWRYSWEEQSSEQLLRREIFLTITMT

SEQ ID NO: 858602 - protein, 520 aa, Homo sapiens
AAAPISSAPPRPEVSASASCVSRVSAPAAPRPCPAVARRLQPSLWQPRPPGRSGAHCAARVPAACMDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 858603 - protein, 298 aa, Homo sapiens
MLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 858604 - protein, 520 aa, Homo sapiens; identical to SEQ ID NO: 858602

SEQ ID NO: 858605 - protein, 414 aa, Homo sapiens
MWCQRGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 858606 - protein, 427 aa, Homo sapiens
VANSAPRGGGRRGGSPDPGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 858607 - protein, 520 aa, Homo sapiens; identical to SEQ ID NO: 858602

SEQ ID NO: 858608 - protein, 520 aa, Homo sapiens; identical to SEQ ID NO: 858602

SEQ ID NO: 858609 - protein, 520 aa, Homo sapiens; identical to SEQ ID NO: 858602

SEQ ID NO: 858610 - protein, 215 aa, Homo sapiens
MWCQRGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNSGMRCWC

SEQ ID NO: 858611 - protein, 497 aa, Homo sapiens
AAAPISSAPPRPEVSASASCVSRVSAPAAPRPCPAVARRLQPSLWQPRPPGRSGAHCAARVPAACMDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQTALPTVLKGKRWNYC

SEQ ID NO: 858612 - protein, 417 aa, Homo sapiens
AAAPISSAPPRPEVSASASCVSRVSAPAAPRPCPAVARRLQPSLWQPRPPGRSGAHCAARVPAACMDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISGDRAEGAENKTSDKANNNRGLSSSSGMGATACFSFSSHPQFVWENGDVLSTLSHDI

SEQ ID NO: 858613 - protein, 485 aa, Homo sapiens
AAAPISSAPPRPEVSASASCVSRVSAPAAPRPCPAVARRLQPSLWQPRPPGRSGAHCAARVPAACMDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKATVNPQATVNPQATVNPQATVNP

SEQ ID NO: 858614 - protein, 520 aa, Homo sapiens; identical to SEQ ID NO: 858602

SEQ ID NO: 858615 - protein, 208 aa, Homo sapiens
VANSAPRGGGRRGGSPDPGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFDSGKDYVRRAMKRRGDRATDRKGY

SEQ ID NO: 858616 - protein, 455 aa, Homo sapiens
MDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 858617 - protein, 520 aa, Homo sapiens; identical to SEQ ID NO: 858602

SEQ ID NO: 858618 - protein, 484 aa, Homo sapiens
RPRPFPLLRRGRRYPHRRAASPGCRPRRLPDRARLWRGGSSPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 858619 - protein, 321 aa, Homo sapiens
AAAPISSAPPRPEVSASASCVSRVSAPAAPRPCPAVARRLQPSLWQPRPPGRSGAHCAARVPAACMDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNSGMRCWC

SEQ ID NO: 858620 - protein, 347 aa, Homo sapiens
MKAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 858621 - protein, 520 aa, Homo sapiens; identical to SEQ ID NO: 858602

SEQ ID NO: 858622 - protein, 433 aa, Homo sapiens
AAAPISSAPPRPEVSASASCVSRVSAPAAPRPCPAVARRLQPSLWQPRPPGRSGAHCAARVPAACMDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISGDRAEGAENKTSDKANNNRGLSSSSGSGGSSKSQSSTSPEGQALENRMKQLSLQCSKGRDGIIADIKMVQIG

SEQ ID NO: 858623 - protein, 520 aa, Homo sapiens; identical to SEQ ID NO: 858602

SEQ ID NO: 858624 - protein, 520 aa, Homo sapiens; identical to SEQ ID NO: 858602

SEQ ID NO: 858625 - protein, 274 aa, Homo sapiens
AAAPISSAPPRPEVSASASCVSRVSAPAAPRPCPAVARRLQPSLWQPRPPGRSGAHCAARVPAACMDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSK

SEQ ID NO: 858626 - protein, 302 aa, Homo sapiens
AFFTEKYLQEHPEDQEKVELLKRLIALQMPLLTEGIRIHGEKLTEQLKPLHERLSSCFRELKEKVEKHYGVITLPPNLTERKQSRTGSIVLPYIMSSTLRRLSITSVTSSVVSTSSNSSDNAPSRPGSDGSILEPLLERRASSGARVEDLSLREENSENRISKFKRKDWSLSKSQVIAEKAPEPDLMSPTRKAQRPKSLQLMDNRLSPFHGSSPPQSTPLSPPPLTPKATRTLSSPSLQTDGIAATPVPPPPPPKSKPYEGSQRNSTELAPPLPVRREAKAPPPPPPKARKSGIPTSEPGSQ

SEQ ID NO: 858627 - protein, 302 aa, Homo sapiens; identical to SEQ ID NO: 858626

SEQ ID NO: 858628 - protein, 111 aa, Homo sapiens
TSAGGFGSELMDNRLSPFHGSSPPQSTPLSPPPLTPKATRTLSSPSLQTDGIAATPVPPPPPPKSKPYEGSQRNSTELAPPLPVRREAKAPPPPPPKARKSGIPTSEPGSQ

SEQ ID NO: 858629 - protein, 241 aa, Homo sapiens
PVCRLGNGTHKHARRAVAVWIWPLGNRVMSRPKMTSLYPEKTQRIYKLPELIIQQGHQIQEPKLQGPWIVKGKRARAESIDPVQDHPHEHTHGRPSPQARMGGSEGDTRSSDDQKDDIPVENYVAQRYIENPYLIGGRKFDLRVYVLVMSYIPLRAWLYRDGFARFSNTRFTLNSIDDQYVHLTNVAVQKTSPDYHPKKGCKWTLQRFRQYLASKHGPEAVETLFRDIDNIFVKSLQSVQK

SEQ ID NO: 858630 - protein, 290 aa, Homo sapiens
PVCRLGNGTHKHARRAVAVWIWPLGNRVMSRPKNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPDTRSSDDQKDDIPVENYVAQRYIENPYLIGGRKFDLRVYVLVMSYIPLRAWLYRDGFARFSNTRFTLNSIDDQYVHLTNVAVQKTSPDYHPKKVAPGGQCVPITDSQQPGRL

SEQ ID NO: 858631 - protein, 299 aa, Homo sapiens
MVPSREALLGPGTTAIRCPKKLQMTSLYPEKTQRIYKLPELIISKGIKYKNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGEMAVSAPALPLHGHQTVSQQALTSSLPRAQPDTRHEGMHGKRWVLQSPTS

SEQ ID NO: 858632 - protein, 281 aa, Homo sapiens
MVPSREALLGPGTTAIRCPKKLQMTSLYPEKTQRIYKLPELIISKGIKYKNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGRKFDLRVYVLVMSVAPGGQCVPITDSQQPGRL

SEQ ID NO: 858633 - protein, 330 aa, Homo sapiens
MVPSREALLGPGTTAIRCPKKLQMTSLYPEKTQRIYKLPELIISKGIKYKNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGRKFDLRVYVLVMSYIPLRAWLYRDGFARFSNTRFTLNSIDDQYVHLTNVAVQKTSPDYHPKKVAPGGQCVPITDSQQPGRL

SEQ ID NO: 858634 - protein, 281 aa, Homo sapiens; identical to SEQ ID NO: 858632

SEQ ID NO: 858635 - protein, 437 aa, Homo sapiens
MVPSREALLGPGTTAIRCPKKLQMTSLYPEKTQRIYKLPELIISKGIKYKNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGRKFDLRVYVLVMSVAPGGQCVPITDSQQQEDYELKTCLLEDTLHVVDMEARLRQRSEETTEAALLLPSSSEESFQLIPSCQEEISLSRCHPGLPPTPRSQHSTSQHSPPHLQPGTSFAGLAAAAYYLNWAPWIPPAHPQASLHQETANHWDWGRFNLDKLTWQLGPKRTNTASSATPRRSYLINEHRP

SEQ ID NO: 858636 - protein, 476 aa, Homo sapiens
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQKQACMLIRNLVAHGQAFSKPILDLGAEALIMQARSAHRDCEDVAKAALRDLGCHVELRELWTGQRGNLAP

SEQ ID NO: 858637 - protein, 476 aa, Homo sapiens; identical to SEQ ID NO: 858636

SEQ ID NO: 858638 - protein, 476 aa, Homo sapiens; identical to SEQ ID NO: 858636

SEQ ID NO: 858639 - protein, 492 aa, Homo sapiens
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQVGRAGDGGRQAGVDVQKQACMLIRNLVAHGQAFSKPILDLGAEALIMQARSAHRDCEDVAKAALRDLGCHVELRELWTGQRGNLAP

SEQ ID NO: 858640 - protein, 476 aa, Homo sapiens; identical to SEQ ID NO: 858636

SEQ ID NO: 858641 - protein, 142 aa, Homo sapiens
VRRRGPPRPGSLAQGRAVRFFWADALEAKHFPAGGGDHRERPGRGGKDASVAHEVASLALPWFAVVLGYRERPRVSGRPSLGAPQRLRAYGGRKGLEAAPWVTTARPTFPHVAAKTGTCALSACCVSGPVLGSGDKEATGYK

SEQ ID NO: 858642 - protein, 91 aa, Homo sapiens
MEFIWGMMEGSGLGGTFLSLPSSQQGALQAQVAPGVPWGLPGARGHSNRQKGWTLPVEQDLHQNRGPCGWFFPPPPPSPFLPAAFLDNPGI

SEQ ID NO: 858643 - protein, 501 aa, Homo sapiens
MSERCCSRYSSGASIGCTPTSTQAKMVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQKQACMLIRNLVAHGQAFSKPILDLGAEALIMQARSAHRDCEDVAKAALRDLGCHVELRELWTGQRGNLAP

SEQ ID NO: 858644 - protein, 608 aa, Homo sapiens
VRRRGPPRPGSLAQGRAVRFFWADALEAKHFPAGGGDHRERPGRGGKDASVAHEVASLALPWFAVVLGYRERPRVSGRPSLGAPQRLRAYGGRKGLEAAPWVTTARPTFPHVAAKTGSGASIGCTPTSTQAKMVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQKQACMLIRNLVAHGQAFSKPILDLGAEALIMQARSAHRDCEDVAKAALRDLGCHVELRELWTGQRGNLAP

SEQ ID NO: 858645 - protein, 408 aa, Homo sapiens
MLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQKQACMLIRNLVAHGQAFSKPILDLGAEALIMQARSAHRDCEDVAKAALRDLGCHVELRELWTGQRGNLAP

SEQ ID NO: 858646 - protein, 430 aa, Homo sapiens
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQKQACMLIRNLVAHGQAFSKPILDLGAEALIMQARSAHRDCEDVAKAALRDLGCHVELRELWTGQRGNLAP

SEQ ID NO: 858647 - protein, 476 aa, Homo sapiens; identical to SEQ ID NO: 858636

SEQ ID NO: 858648 - protein, 645 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGSADRGVQGSVRFSDSSVSAAIEETVD

SEQ ID NO: 858649 - protein, 1437 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSVTNFYMLTVTKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 858650 - protein, 168 aa, Homo sapiens
AAPRESGWGGFVRGGGGRGGGGGQHGGGGRGGCAQVAAERRANSEPSAEDRATQAGLPAAGSSLAAAAARRPPSLGLPFPSHLPSLPLPAARPARPGRGPPQCRPPWQRRPARGKSSPGISCGLARFRLLLARPQRLPAPQPHSGPPCLSCDRTDTAGGLEWNKLKAR

SEQ ID NO: 858651 - protein, 645 aa, Homo sapiens; identical to SEQ ID NO: 858648

SEQ ID NO: 858652 - protein, 1388 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSVTNFYMLTVTKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 858653 - protein, 627 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGSADRGVQGSVRFSDSSVSAAIEETVD

SEQ ID NO: 858654 - protein, 409 aa, Homo sapiens
FCHMMTSAVKPMKDMAPPTTVFHSFEPLFISAKLSLNLMRYNSTFSSMERLLQEAFSLSFSAFWLQTGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGSADRGVQGSVRFSDSSVSAAIEETVD

SEQ ID NO: 858655 - protein, 645 aa, Homo sapiens; identical to SEQ ID NO: 858648

SEQ ID NO: 858656 - protein, 1426 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 858657 - protein, 611 aa, Homo sapiens [sequence omitted]

SEQ ID NO: 858658 - protein, 102 aa, Homo sapiens
MWSYLNYIDVKVSLSEFLFVCLNHFLGSVEKKQQRRSIRTRSESEKSTEVVPKKKIKKEQVETVPQATVKTGLQKGSADRGVQGSVRFSDSSVSAAIEETVD

SEQ ID NO: 858659 - protein, 102 aa, Homo sapiens; identical to SEQ ID NO: 858658

SEQ ID NO: 858660 - protein, 250 aa, Homo sapiens
DVSGRDLIYVKGTFLFFLKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 858661 - protein, 140 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVP

SEQ ID NO: 858662 - protein, 645 aa, Homo sapiens; identical to SEQ ID NO: 858648

SEQ ID NO: 858663 - protein, 645 aa, Homo sapiens; identical to SEQ ID NO: 858648

SEQ ID NO: 858664 - protein, 645 aa, Homo sapiens; identical to SEQ ID NO: 858648

SEQ ID NO: 858665 - protein, 580 aa, Homo sapiens
LFNKGRSGMGWWGVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGSADRGVQGSVRFSDSSVSAAIEETVD

SEQ ID NO: 858666 - protein, 611 aa, Homo sapiens [sequence omitted]

SEQ ID NO: 858667 - protein, 1251 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSDRIIDAGPKGNYSRFMNHSCNPNCETQKWTVNGDVRVGLFALCDIPADRKSDSFPM

SEQ ID NO: 858668 - protein, 161 aa, Homo sapiens
MHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGSADRGVQGSVRFSDSSVSAAIEETVD

SEQ ID NO: 858669 - protein, 478 aa, Homo sapiens
ANLVNSGFLFRFCPLESKIAFVFRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 858670 - protein, 102 aa, Homo sapiens
LIVQDHSDPMFSSYAYKSHYLLNESNRAELMKLPMIPSSSASKKKCEKGNNQNSFSCFYFCISYFFLFQYRGEMYACQAPSVAFGKFCLGGCDCFFIWLHNY

SEQ ID NO: 858671 - protein, 264 aa, Homo sapiens
MLLLSLTLSLVLLGSSWGCGIPAIKPALSFSQRIVNGENAVLGSWPWQVSLQDSSGFHFCGGSLISQSWVVTAAHCNVSPGRHFVVLGEYDRSSNAEPLQVLSVSRAITHPSWNSTTMNNDVTLLKLASPAQYTTRISPVCLASSNEALTEGLTCVTTGWGRLSGVGNVTPAHLQQVALPLVTVNQCRQYWGSSITDSMICAGGAGASSCQGDSGGPLVCQKGNTWVLIGIVSWGTKNCNVRAPAVYTRVSKFSTWINQVIAYN

SEQ ID NO: 858672 - protein, 258 aa, Homo sapiens [sequence omitted]

SEQ ID NO: 858673 - protein, 264 aa, Homo sapiens; identical to SEQ ID NO: 858671

SEQ ID NO: 858674 - protein, 147 aa, Homo sapiens [sequence omitted]

SEQ ID NO: 858675 - protein, 147 aa, Homo sapiens
MDSSGFHFCGGSLISQSWVVTAAHCNVSPGRHFVVLGEYDRSSNAEPLQVLSVSRAITHPSWNSTTMNNDVTLLKLASPAQYTTRISPVCLASSNEALTEGLTCVTTGWGRLSGVGNVTPAHLQQVALPLVTVNQCRQYWGCCVYSS

SEQ ID NO: 858676 - protein, 499 aa, Homo sapiens
RSGLRSSLALGLGSRCERPPCPRTALSAHRRASRAGPSTSAPRGRTEAASSAAGCGADPGDEMTTSTLQKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMGAVVMEKPNIRWNDVAGLEGAKEALKEAVILPIKFPHLFTGKRTPWRGILLFGPPGTGKSYLAKAVATEANNSTFFSVSSSDLMSKWLGESEKLVKNLFELARQHKPSIIFIDEVDSLCGSRNENESEAARRIKTEFLVQMQGVGNNNDGTLVLGATNIPWVLDSAIRRRFEKRIYIPLPEEAARAQMFRLHLGSTPHNLTDANIHELARKTEGYSGADISIIVRDSLMQPVRKVQSATHFKKVCGPSRTNPSMMIDDLLTPCSPGDPGAMEMTWMDVPGDKLLEPVVCMSDMLRSLATTRPTVNADDLLKVKKFSEDFGQES

SEQ ID NO: 858677 - protein, 499 aa, Homo sapiens; identical to SEQ ID NO: 858676

SEQ ID NO: 858678 - protein, 499 aa, Homo sapiens; identical to SEQ ID NO: 858676

SEQ ID NO: 858679 - protein, 499 aa, Homo sapiens; identical to SEQ ID NO: 858676

SEQ ID NO: 858680 - protein, 499 aa, Homo sapiens; identical to SEQ ID NO: 858676

SEQ ID NO: 858681 - protein, 426 aa, Homo sapiens
RSGLRSSLALGLGSRCERPPCPRTALSAHRRASRAGPSTSAPRGRTEAASSAAGCGADPGDEMTTSTLQKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMGAVVMEKPNIRWNDVAGLEGAKEALKEAVILPIKFPHLFTGKRTPWRGILLFGPPGTGKSYLAKAVATEANNSTFFSVSSSDLMSKWLGESEKLVKNLFELARQHKPSIIFIDEVDSLCGSRNENESEAARRIKTEFLVQMQGVGNNNDGTLVLGATNIPWVLDSAIRRRFEKRIYIPLPEEAARAQMFRLHLGSTPHNLTDANIHELARKTEGYSGADISIIVRDSLMQPVRKVQSATHFKKVSARGHC

SEQ ID NO: 858682 - protein, 196 aa, Homo sapiens
MSEAPRIKRSLGSDAGVGNNNDGTLVLGATNIPWVLDSAIRRRFEKRIYIPLPEEAARAQMFRLHLGSTPHNLTDANIHELARKTEGYSGADISIIVRDSLMQPVRKVQSATHFKKVCGPSRTNPSMMIDDLLTPCSPGDPGAMEMTWMDVPGDKLLEPVVCMSDMLRSLATTRPTVNADDLLKVKKFSEDFGQES

SEQ ID NO: 858683 - protein, 346 aa, Homo sapiens
RSGLRSSLALGLGSRCERPPCPRTALSAHRRASRAGPSTSAPRGRTEAASSAAGCGADPGDEMTTSTLQKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMGAVVMEKPNIRWNDVAGLEGAKEALKEAVILPIKFPHLFTGKRTPWRGILLFGPPGTGKSYLAKAVATEANNSTFFSVSSSDLMSKWLGESEKLVKNLFELARQHKPSIIFIDEVDSLCGSRNENESEAARRIKTEFLVQMQGVGNNNDGTLVLGATNIPWVLDSAIRRR

SEQ ID NO: 858684 - protein, 211 aa, Homo sapiens
RSGLRSSLALGLGSRCERPPCPRTALSAHRRASRAGPSTSAPRGRTEAASSAAGCGADPGDEMTTSTLQKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMALPQRPSDISHSHPPRFTSRAVSSLGEEMVSFRSG

SEQ ID NO: 858685 - protein, 499 aa, Homo sapiens; identical to SEQ ID NO: 858676

SEQ ID NO: 858686 - protein, 426 aa, Homo sapiens; identical to SEQ ID NO: 858681

SEQ ID NO: 858687 - protein, 499 aa, Homo sapiens; identical to SEQ ID NO: 858676

SEQ ID NO: 858688 - protein, 499 aa, Homo sapiens; identical to SEQ ID NO: 858676

SEQ ID NO: 858689 - protein, 426 aa, Homo sapiens; identical to SEQ ID NO: 858681

SEQ ID NO: 858690 - protein, 107 aa, Homo sapiens
MRVRPPGGSKRSSWSRCRGWGITMMGLWFLEPQTSHGCWIRPSGGGLKNEFISPCRRKLPAPRCSGCISGALPTTSRMQTSTSWPGRRKATRARTSASSCGTLSCSP

SEQ ID NO: 858691 - protein, 346 aa, Homo sapiens; identical to SEQ ID NO: 858683

SEQ ID NO: 858692 - protein, 1401 aa, Homo sapiens [sequence omitted]

SEQ ID NO: 858693 - protein, 1401 aa, Homo sapiens [sequence omitted]

SEQ ID NO: 858694 - protein, 1401 aa, Homo sapiens [sequence omitted]

SEQ ID NO: 858695 - protein, 1401 aa, Homo sapiens [sequence omitted]

SEQ ID NO: 858696 - protein, 737 aa, Homo sapiens [sequence omitted]

SEQ ID NO: 858697 - protein, 1323 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRSNLMVATGDLAIRFPNLVDPWTPHLYARLRDPAQQVRKTAGLVMTHLILKDMVKVKGQVSEMAVLLIDPEPQIAALAKNFFNELSHKGNAIYNLLPDIISRLSDPELGVEEEPFHTIMKQLLSYITKDKQTESLVEKLCQRFRTSRTERQQRDLAYCVSQLPLTERGLRKMLDNFDCFGDKLSDESIFSAFLSVVGKLRRGAKPEGKAIIDEFEQKLRACHTRGLDGIKELEIGQAGSQRAPSAKKPSTGT

SEQ ID NO: 858698 - protein, 1112 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRSNLMVATGDLAIRFPNLVDPWTPHLYARLRDPAQQVPLCS

SEQ ID NO: 858699 - protein, 890 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARRGLDGIKELEIGQAGSQRAPSAKKPSTGSRYQPLASTASDNDFVTPEPRRTTRRHPNTQQRASKKKPKVVFSSDESSEEDLSAEMTEDETPKKTTPILRASARRHRS

SEQ ID NO: 858700 - protein, 876 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFWSQPQEPNFLESPISKGRL

SEQ ID NO: 858701 - protein, 226 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSINLERKFVQFGLLGLFGLTRPFLGKSPPILNSPQKKPA

SEQ ID NO: 858702 - protein, 1377 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILIWRRWCCRFSVAINWKQQPETPETSSWILYKPMAMDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRSNLMVATGDLAIRFPNLVDPWTPHLYARLRDPAQQVRKTAGLVMTHLILKDMVKVKGQVSEMAVLLIDPEPQIAALAKNFFNELSHKGNAIYNLLPDIISRLSDPELGVEEEPFHTIMKQLLSYITKDKQTESLVEKLCQRFRTSRTERQQRDLAYCVSQLPLTERGLRKMLDNFDCFGDKLSDESIFSAFLSVVGKLRRGAKPEGKAIIDEFEQKLRACHTRGLDGIKELEIGQAGSQRAPSAKKPSTGSRYQPLASTASDNDFVTPEPRRTTRRHPNTQQRASKKKPKVVFSSDESSEEDLSAEMTEDETPKKTTPILRASARRHRS

SEQ ID NO: 858703 - protein, 1386 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRNLVDPWTPHLYARLRDPAQQVRKTAGLVMTHLILKDMVKVKGQVSEMAVLLIDPEPQIAALAKNFFNELSHKGNAIYNLLPDIISRLSDPELGVEEEPFHTIMKQLLSYITKDKQTESLVEKLCQRFRTSRTERQQRDLAYCVSQLPLTERGLRKMLDNFDCFGDKLSDESIFSAFLSVVGKLRRGAKPEGKAIIDEFEQKLRACHTRGLDGIKELEIGQAGSQRAPSAKKPSTGSRYQPLASTASDNDFVTPEPRRTTRRHPNTQQRASKKKPKVVFSSDESSEEDLSAEMTEDETPKKTTPILRASARRHRS

SEQ ID NO: 858704 - protein, 1219 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRSNLMVATGDLAIRFPNLVDPWTPHLYARLRDPAQQVRKTAGLVMTHLILKDMVKVKGQVSEMAVLLIDPEPQIAALAKNFFNELSHKGNAIYNLLPDIISRLSDPELGVEEEPFHTIMKQLLSYITKDKQTESLVEKLCQRFRTSRL

SEQ ID NO: 858705 - protein, 1072 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISALFWGIPNFLFVPLPGKKVFHFPF

SEQ ID NO: 858706 - protein, 1012 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQMLL

SEQ ID NO: 858707 - protein, 32 aa, Homo sapiens
MLPTFLLMNLLSLAGDVALQQLVHLEQAVSGE

SEQ ID NO: 858708 - protein, 187 aa, Homo sapiens
MWSAGDGQRVCRSLLGFSDPSSASASMVASMNQDCLKGLYPLSQRPGFMLSEEADALPRGECSWIRMLVQRMPCLHIYQRFPYPQLLGGFFFLESFTTFCKGSMLCLVPKTKTVFTFSVLLESDQLRAMAGEGMAREGYSEGRMRGGFPQVKVSQRRIEFSPPNHIQHLPNFPQCGMKPLGQSLHFP

SEQ ID NO: 858709 - protein, 785 aa, Homo sapiens
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 858710 - protein, 824 aa, Homo sapiens
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIDRTSPACRGPWDFLDVSIPWEHLQAIIWRSPSCLHPTTAGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 858711 - protein, 785 aa, Homo sapiens; identical to SEQ ID NO: 858709

SEQ ID NO: 858712 - protein, 144 aa, Homo sapiens
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLITTCWKYI

SEQ ID NO: 858713 - protein, 785 aa, Homo sapiens; identical to SEQ ID NO: 858709

SEQ ID NO: 858714 - protein, 383 aa, Homo sapiens [sequence omitted]

SEQ ID NO: 858715 - protein, 333 aa, Homo sapiens
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSLLALCRIPGHPRHLSQHCPSRPGSAPTPDTSLNLNTRKEDTRSLEV

SEQ ID NO: 858716 - protein, 204 aa, Homo sapiens
PMSCSLTTLGLEHSLPRPATEPLERPSRSHIAPTEYSQLVPLSSCGCEGLLPLPQATITSHSHPEAGPGLEARTPELQLFSGQLSFWSAAEETKTRPPQARATKPPKPKSSWQRSCISSEKSETPGLPIDFPSCPYALVRLPLRSSLSNQEVRVPQGSSRAKSLPAREWEAWPHPATATLRAWAWHCSGVPLMERGGSRSGPGR

SEQ ID NO: 858717 - protein, 144 aa, Homo sapiens
GDLPLSDSGRGCLSEGQAFRLHSLPLTGIQEFCGPSHCHRAIAAAQALGTRQSGTPCSNTDEETEAPSASSSRPHGEWNSPYQPGKQTSLCHSRDNPLSSCSYLASGILGRDKRLKKGHIKTPSSWSLPSFHHPPASACTLSGL

SEQ ID NO: 858718 - protein, 204 aa, Homo sapiens; identical to SEQ ID NO: 858716

SEQ ID NO: 858719 - protein, 77 aa, Homo sapiens
LQGHYLFVQPAGHRPALEVEAIRQQVEAVLAGHEAVRWHSEQRLLRRAKRSVHFNDPKYPQQWHLVSPVLQFAVSGG

SEQ ID NO: 858720 - protein, 268 aa, Homo sapiens
RGKGHLRSPRGTLPGCFHGYYRRKCCWGKVSSLAHAFHLFLLCSFLRDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 858721 - protein, 785 aa, Homo sapiens; identical to SEQ ID NO: 858709

SEQ ID NO: 858722 - protein, 129 aa, Homo sapiens
QHNDNCNYDGYANKHYQINDITAAWGPDDDGKTVDGPHQLGKAALQHGVIAGRQGFGSIFVVASGNGGQHNDKSCFTRESCGRTAEQMADAHVGGESLGSHCHSSPATTLSSSASAQGNGLPAGGQLSA

SEQ ID NO: 858723 - protein, 676 aa, Homo sapiens
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKVLRPEDSSCG

SEQ ID NO: 858724 - protein, 865 aa, Homo sapiens
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGSHPMFLCSCVCVTEGLGHHTSCPSFCVCLNVLSTIISLGSDRTSPACRGPWDFLDVSIPWEHLQAIIWRSPSCLHPTTAGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 858725 - protein, 268 aa, Homo sapiens; identical to SEQ ID NO: 858720

SEQ ID NO: 858726 - protein, 103 aa, Homo sapiens [sequence omitted]

SEQ ID NO: 858727 - protein, 176 aa, Homo sapiens [sequence omitted]

SEQ ID NO: 858728 - protein, 513 aa, Homo sapiens [sequence omitted]

SEQ ID NO: 858729 - protein, 279 aa, Homo sapiens
GTGRSCPGAVTIASVTEPQSLARAEGTTRVWVRQAKRDGCSQGAGGGPGSGLALSALTDDLPRSSVACHAGLGGPSVAAHLKANDMLSLLQLALCEFPLMLLRFLHKPVGISTVVPIILGHCQAAQSHQGPLHCCHVFAFKEVNSLEHVSLDDPIVLSRLQELSHLLHLLEDHGGWVLGHLHRLGAIRVQAVHQLAQNHAILQPDLEAQAPTVWAAHIRATLQHDPLHQPLLQLLVILLLDFGLHFAAHAIGRTLVGHVWGKLSTDVTLGCCAFSPVFV

SEQ ID NO: 858730 - protein, 333 aa, Homo sapiens
GTGRSCPGAVTIASVTEPQSLARAEGTTRVWVRQAKRDGCSQGAGGGPGSGLALSALTDDLPRSSVACHAGLGGPSVAAHLKANDMLSLLQLALCEFPLMLLRFLHKPVGISTVVPIILGHCQAAQSHQGPLHCCHVFAFKEVNSLEHVSLDDPIVLSRLQELSHLLHLLEDHGGWVLGHLHRLGAIRVQAVHQLAQNHAILQPDLEAQAPTVWAAHIRATLQHDPLHQPLLQLLVILLLDFGLHFAAHAIGRTLVGHVWGKLKQARVEEGGAEGQGAALLSPVPGSLLALCRIPGHPRHLSQHCPSRPGSAPTPDTSLNLNTRKEDTRSLEV

SEQ ID NO: 858731 - protein, 294 aa, Homo sapiens
KIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGLAAFHHPRAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALASSTMKIKLIAPPERKYSVWIGGSILASLSTFQQMWISKQEYDESGPSIVHRKCF

SEQ ID NO: 858732 - protein, 294 aa, Homo sapiens; identical to SEQ ID NO: 858731

SEQ ID NO: 858733 - protein, 294 aa, Homo sapiens; identical to SEQ ID NO: 858731

SEQ ID NO: 858734 - protein, 294 aa, Homo sapiens; identical to SEQ ID NO: 858731

SEQ ID NO: 858735 - protein, 294 aa, Homo sapiens; identical to SEQ ID NO: 858731

SEQ ID NO: 858736 - protein, 320 aa, Homo sapiens
RRGKRFGAGAGLPAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 858737 - protein, 73 aa, Homo sapiens
SRGEKSILMFITDFFLTSKYCSLQALYDHLMDFLADRGVDNTFADELVELSTALEHQEYITFLEDLKSFVKSQ

SEQ ID NO: 858738 - protein, 194 aa, Homo sapiens
MQVIVMSATMDVDLFSQYFNGAPVLYLEGRQHPIQVFYTKQPQNDYLHAALVSVFQIHQEAPSSQDILVFLTGQEEIEAMSKTCRDIAKHLPDGCPAMLVLPLYASLPYAQQLRVFQGAPKGIASDHSTKSLNSKTLREYDMCMNTSACKATEVYPDTDIRGKPSRGTKNNGWRRRRGSKKDAGTLNGTTGGRN

SEQ ID NO: 858739 - protein, 320 aa, Homo sapiens; identical to SEQ ID NO: 858736

SEQ ID NO: 858740 - protein, 320 aa, Homo sapiens; identical to SEQ ID NO: 858736

SEQ ID NO: 858741 - protein, 320 aa, Homo sapiens; identical to SEQ ID NO: 858736

SEQ ID NO: 858742 - protein, 320 aa, Homo sapiens; identical to SEQ ID NO: 858736

SEQ ID NO: 858743 - protein, 282 aa, Homo sapiens
MLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 858744 - protein, 314 aa, Homo sapiens
RRGKRFGAGAGLPAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVERPRRLLFLSLEFGDAYDV

SEQ ID NO: 858745 - protein, 317 aa, Homo sapiens
RRGKRFGAGAGLPAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVERRRCALFVPSADFYTVTSCWL

SEQ ID NO: 858746 - protein, 312 aa, Homo sapiens
GGGPRCSPVPPYGSACPLYSADCPDYCYVMAGVCCTTMCRSVGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 858747 - protein, 773 aa, Homo sapiens
MPEEAGFPPAKRFRPGSGPPSRAGSFPPGRQVVMLLTAGSGGRGGGGGRRQQPPLAQPSASPYPEAVELQRRSLPIFQARGQLLAQLRNLDNAVLIGGYTVRFDDVTSEDTRIKFLTDGMLLREAISDSLLRKYSCVILDEAHERTIHTDVLFGVVKAAQKRRKELGKLPLKVIVMSATMDVDLFSQYFNGAPVLYLEGRQHPIQVFYTKQPQNDYLHAALVSVFQIHQEAPSSQDILVFLTGQEEIEAMSKTCRDIAKHLPDGCPAMLVLPLYASLPYAQQLRVFQGAPKGYRKVIISTNIAETSITITGIKYVVDTGMVKAKKYNPDSGLEVLAVQRVSKTQAWQRTGRAGREDSGICYRLYTEDEFEKFDKMTVPEIQRCNLASVMLQLLAMKVPNVLTFDFMSKPSPDHIQAAIAQLDLLGALEHKDDQLTLTPMGRKMAAFPLEPKFAKTILMSPKFHCTEEILTIVSLLSVDSVLHNPPSRREEVQGVRKKFISSEGDHMTLLNIYRTFKNLGGNKDWCKENFVNSKNMTLVAEVRAQLRDICLKVSSGPSVLWVTSCHFVQGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 858748 - protein, 359 aa, Homo sapiens
RRGKRFGAGAGLPAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKVLLCLQAGEQWRDLGSLQPPPPRFKQFSCLSLLSSWDYRITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 858749 - protein, 653 aa, Homo sapiens
MPEEAGFPPAKRFRPGSGPPSRAGSFPPGRQVVMLLTAGSGGRGGGGGRRQQPPLAQPSASPYPEAVELQRRSLPIFQARGQLLAQLRNLDNAVLIGGYTVRFDDVTSEDTRIKFLTDGMLLREAISDSLLRKYSCVILDEAHERTIHTDVLFGVVKAAQKRRKELGKLPLKVIVMSATMDVDLFSQYFNGAPVLYLEGRQHPIQVFYTKQPQNDYLHAALVSVFQIHQEAPSSQDILVFLTGQEEIEAMSKTCRDIAKHLPDGCPAMLVLPLYASLPYAQQLRVFQGAPKGYRKVIISTNIAETSITITGIKYVVDTGMVKAKKYNPDSGLEVLAVQRVSKTQAWQRTGRAGREDSGICYRLYTEDEFEKFDKMTVPEIQRCNLASVMLQLLAMKVPNVLTFDFMSKPSPDHIQAAIAQLDLLGALEHKDDQLTLTPMGRKMAAFPLEPKFAKTILMSPKFHCTEEILTIVSLLSVDSVLHNPPSRREEVQGVRKKFISSEGDHMTLLNIYRTFKNLGGNKDWCKENFVNSKNMTLVAEVRAQLRDICLKMSMPIASSRGDVESVRRCLAHSLFMSTAELQPDGTYATTDTHQPVAIHPSSVLFHCKPACVVYTELLYTNKCYMRDLCVIDAQWLYEAAPEYFRRKLRTARN

SEQ ID NO: 858750 - protein, 287 aa, Homo sapiens
RRGKRFGAGAGLPAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 858751 - protein, 653 aa, Homo sapiens; identical to SEQ ID NO: 858749

SEQ ID NO: 858752 - protein, 268 aa, Homo sapiens
RRGKRFGAGAGLPAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEWTRRRGVKPRKQVCTKRAHQRKNRTVVQPAKPLNTSTN

SEQ ID NO: 858753 - protein, 181 aa, Homo sapiens
RRGKRFGAGAGLPAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKRNPRKGRRLKNRSLN

SEQ ID NO: 858754 - protein, 80 aa, Homo sapiens
TMDVDLFSQYFNGAPVLYLEGRQHPIQVFYTKQPQNDYLHAALVSVFQIHQVWCWGQIPEKFSFILQLVVRTLSLEKKSY

SEQ ID NO: 858755 - protein, 320 aa, Homo sapiens; identical to SEQ ID NO: 858736

SEQ ID NO: 858756 - protein, 91 aa, Homo sapiens
TQHRFASGLKANFPDEEVSFQSTGESEWKDTNYTLNTDSLDWALYDHLMDFLADRGVDNTFADELVELSTALEHQEYITFLEDLKSFVKSQ

SEQ ID NO: 858757 - protein, 404 aa, Homo sapiens [sequence omitted]

SEQ ID NO: 858758 - protein, 707 aa, Homo sapiens
MPEEAGFPPAKRFRPGSGPPSRAGSFPPGRQVVMLLTAGSGGRGGGGGRRQQPPLAQPSASPYPEAVELQRRSLPIFQARGQLLAQLRNLDNAVLIGETGSGKTTQIPQYLYEGGISRQGIIAVTQPRRVAAISLATRVSDEKRTELGKLVGYTVRFDDVTSEDTRIKFLTDGMLLREAISDSLLRKYSCVILDEAHERTIHTDVLFGVVKAAQKRRKELGKLPLKVIVMSATMDVDLFSQYFNGAPVLYLEGRQHPIQVFYTKQPQNDYLHAALVSVFQIHQEAPSSQDILVFLTGQEEIEAMSKTCRDIAKHLPDGCPAMLVLPLYASLPYAQQLRVFQGAPKGYRKVIISTNIAETSITITGIKYVVDTGMVKAKKYNPDSGLEVLAVQRVSKTQAWQRTGRAGREDSGICYRLYTEDEFEKFDKMTVPEIQRCNLASVMLQLLAMKVPNVLTFDFMSKPSPDHIQAAIAQLDLLGALEHKDDQLTLTPMGRKMAAFPLEPKFAKTILMSPKFHCTEEILTIVSLLSVDSVLHNPPSRREEVQGVRKKFISSEGDHMTLLNIYRTFKNLGGNKDWCKENFVNSKNMTLVAEVRAQLRDICLKMSMPIASSRGDVESVRRCLAHSLFMSTAELQPDGTYATTDTHQPVAIHPSSVLFHCKPACVVYTELLYTNKCYMRDLCVIDAQWLYEAAPEYFRRKLRTARN

SEQ ID NO: 858759 - protein, 67 aa, Homo sapiens
GICVECIISILPFRFLDWALYDHLMDFLADRGVDNTFADELVELSTALEHQEYITFLEDLKSFVKSQ

SEQ ID NO: 858760 - protein, 66 aa, Homo sapiens
ASRRAFFAAGQSFCQLNKRKKTPPPTPNISTRIFFSFHPQFGWAPKGELIFRHPVNKSYSEARHVL

SEQ ID NO: 858761 - protein, 320 aa, Homo sapiens; identical to SEQ ID NO: 858736

SEQ ID NO: 858762 - protein, 320 aa, Homo sapiens; identical to SEQ ID NO: 858736

SEQ ID NO: 858763 - protein, 319 aa, Homo sapiens
RITRQFPVLISLPGLAYVDLVARLLLHQCHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 858764 - protein, 325 aa, Homo sapiens
RRGKRFGAGAGLPAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELKTALLLPSVLLPSTLVLLFNIESADGRR

SEQ ID NO: 858765 - protein, 181 aa, Homo sapiens; identical to SEQ ID NO: 858753

SEQ ID NO: 858766 - protein, 292 aa, Homo sapiens
RRGKRFGAGAGLPAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTSAQPWSTRSTLLFLKTSRVLSRASRADRC

SEQ ID NO: 858767 - protein, 116 aa, Homo sapiens
PPARYGCEKTTEGKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 858768 - protein, 198 aa, Homo sapiens
RRGKRFGAGAGLPAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEP

SEQ ID NO: 858769 - protein, 227 aa, Homo sapiens
MPEEAGFPPAKRFRPGSGPPSRAGSFPPGRQVVMLLTAGSGGRGGGGGRRQQPPLAQPSASPYPEAVELQRRSLPIFQARGQLLAQLRNLDNAVLIGETGSGKTTQIPQYLYEGGISRQGIIAVTQPRRVAAISLATRVSDEKRTELGKLVGYTVRFDDVTSEDTRIKFLTDGMLLREAISDSLLRKYSCVILDEAHERTIHTDVLFGVVKAAQKRRKELGKLPLKV

SEQ ID NO: 858770 - protein, 1211 aa, Homo sapiens
PALQGDSSAQPAEALRPVQPRRPLAEKAAAEERPSYRPPPAPPQPRRRRRRRHCPPSPRRRILNGNMAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 858771 - protein, 1076 aa, Homo sapiens
MQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 858772 - protein, 1141 aa, Homo sapiens
MQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCECLAGQLALGSAQAAWGQPRGTQRPGRCGNKQAQAKGWAWARARSWRRLLVDLKGGGEGGQGAARRCPHPHPSPPVPGNNFLLHNLILDTGITQQLVERVWRDQDLNTSLPLGCSRAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 858773 - protein, 1191 aa, Homo sapiens
MQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCECLAGQLALGSAQAAWGQPRGTQRPGRCGNKQAQAKGWAWARARSWRRLLVDLKGGGEGGQGAARRCPHPHPSPPVPGNNFLLHNLILDTGITQQLVERVWRDQDLNTSLPLGCSRAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQAGRKGFGGASSSPGPQSELRRLHGEGGVYDRGRPETLPGSVGGAEALWALADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 858774 - protein, 138 aa, Homo sapiens
MKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 858775 - protein, 699 aa, Homo sapiens
MQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCECLAGQLALGSAQAAWGQPRGTQRPGRCGNKQAQAKGWAWARARSWRRLLVEP

SEQ ID NO: 858776 - protein, 83 aa, Homo sapiens
MRIFGGVQQLREIYKDNRNLFEVQENEPQKLVEKVAGDIESLLDRKVQALKVETGGRHCCPSALFLFFFFWGGGSGGVFLFFR

SEQ ID NO: 858777 - protein, 1199 aa, Homo sapiens
PALQGDSSSAARRGAAARAAPEAPRGEGGGGGEAELPPAARCPPSPRRRILNGNMAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 858778 - protein, 1218 aa, Homo sapiens
PALQGDSSAQPAEALRPVQPRRPLAEKAAAEERPSYRPPPAPPQPRRRRRRRHCPPSPRRRILNGNMAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKLPISKLKDFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 858779 - protein, 96 aa, Homo sapiens
DGGGSGRGKLNAPPFRAARRLFHAQRLTNTNLLFVVAEKPLCSQCEAGRLEDTSDCGRGASFPPSLGVLVSLQLLLLLGLPPRPQPQVLVHASRRL

SEQ ID NO: 858780 - protein, 699 aa, Homo sapiens; identical to SEQ ID NO: 858775

SEQ ID NO: 858781 - protein, 95 aa, Homo sapiens
SFRSSSSAATSGQAEEARTTHVSSKCCSKVASIPPTDHSGSEPSGTARPSPPQASVTGRERGVDRNGASKGTKLITVQRPRSLLENITALPSHRA

SEQ ID NO: 858782 - protein, 95 aa, Homo sapiens; identical to SEQ ID NO: 858781

SEQ ID NO: 858783 - protein, 95 aa, Homo sapiens; identical to SEQ ID NO: 858781

SEQ ID NO: 858784 - protein, 95 aa, Homo sapiens; identical to SEQ ID NO: 858781

SEQ ID NO: 858785 - protein, 95 aa, Homo sapiens; identical to SEQ ID NO: 858781

SEQ ID NO: 858786 - protein, 82 aa, Homo sapiens
PDEGLGSPRGDRRGDLHLAPWRNRPARIIPLSGEVCSRASVLQFVAWHFVSVFFNLWTLVQPTPRPRGQILSFTITQGSDRV

SEQ ID NO: 858787 - protein, 95 aa, Homo sapiens; identical to SEQ ID NO: 858781

SEQ ID NO: 858788 - protein, 95 aa, Homo sapiens; identical to SEQ ID NO: 858781

SEQ ID NO: 858789 - protein, 272 aa, Homo sapiens
NVRLGTRLGGGMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGKSTSGDKPVSHSCTTPSTSSASGLNPTSAPPTSASAVPVSPVPQLPPFFGPFLPGPFGPG

SEQ ID NO: 858790 - protein, 647 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 858791 - protein, 602 aa, Homo sapiens
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 858792 - protein, 342 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGIIPTSVFSNCELKWKTSIPVMPVVCSHRIFCLKQADTMTETTDCQEQRLTVVLRQYSTPSNQWFIQLLPQALFLLVHLRYSLITSQRNHLMLMEHLLYQNCLHPHLLSLHRKQKEKNLHQETNPYHILAQLLPRLLPLD

SEQ ID NO: 858793 - protein, 647 aa, Homo sapiens; identical to SEQ ID NO: 858790

SEQ ID NO: 858794 - protein, 544 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGKSTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 858795 - protein, 499 aa, Homo sapiens
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGKSTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 858796 - protein, 647 aa, Homo sapiens; identical to SEQ ID NO: 858790

SEQ ID NO: 858797 - protein, 401 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHTPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 858798 - protein, 517 aa, Homo sapiens
MYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSR

SEQ ID NO: 858799 - protein, 499 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTFKMSWYCNNIFDERRLQTPLKNQLSYAFYFSNLSNLILK

SEQ ID NO: 858800 - protein, 487 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKSTPAWVTQ

SEQ ID NO: 858801 - protein, 393 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEEGKSS

SEQ ID NO: 858802 - protein, 137 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAMYPSRCKYVL

SEQ ID NO: 858803 - protein, 296 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPIQEHPVLRDLQRDLDCHTIIMGHSTVNIRHINETDR

SEQ ID NO: 858804 - protein, 206 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGSKY

SEQ ID NO: 858805 - protein, 147 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDASKYYKHVQYGFFGIFCKKKK

SEQ ID NO: 858806 - protein, 602 aa, Homo sapiens; identical to SEQ ID NO: 858791

SEQ ID NO: 858807 - protein, 647 aa, Homo sapiens; identical to SEQ ID NO: 858790

SEQ ID NO: 858808 - protein, 653 aa, Homo sapiens
MVMYARKQQRLSDGCHDRRGDSQPYQGGDVLQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 858809 - protein, 602 aa, Homo sapiens; identical to SEQ ID NO: 858791

SEQ ID NO: 858810 - protein, 624 aa, Homo sapiens
MAVNSFPKDRDYKKRGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 858811 - protein, 438 aa, Homo sapiens [sequence omitted]

SEQ ID NO: 858812 - protein, 523 aa, Homo sapiens
ANSARGRRRRRTRRRRLRARPPFAAALPPPRHTLTGRALMVMYARKQQRLSDGVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 858813 - protein, 553 aa, Homo sapiens
NVRLGTRLGGGMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGKSTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 858814 - protein, 544 aa, Homo sapiens; identical to SEQ ID NO: 858794

SEQ ID NO: 858815 - protein, 688 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKTGTVNLLPNLNIFELHLSRLWTVKLGKGNDKGTGSVRVNSGERYKIDL

SEQ ID NO: 858816 - protein, 625 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQR

SEQ ID NO: 858817 - protein, 393 aa, Homo sapiens; identical to SEQ ID NO: 858801

SEQ ID NO: 858818 - protein, 390 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEDS

SEQ ID NO: 858819 - protein, 384 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGKSTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKSTPAWVTQ

SEQ ID NO: 858820 - protein, 166 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLER

SEQ ID NO: 858821 - protein, 153 aa, Homo sapiens
GRAGGRAGTQCGGERGPGFAAFRPLRPFRRLRVCAVCVRGSALGRSVGLPRGGAAGAPFSSSPAPHPRRVLCRCLLFLFFSCHDRRGDSQPYQVPAEAGVEGLEGAGGGREGLLLERRPQKSIQALRCNTSETSTADPLKIPGLVPLALSSKV

SEQ ID NO: 858822 - protein, 190 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLV

SEQ ID NO: 858823 - protein, 139 aa, Homo sapiens
MKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSRCFTICFSKSYLIQ

SEQ ID NO: 858824 - protein, 674 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858825 - protein, 706 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEDAEQELLSDDASSVSQIQSQTQSPQNVPEKLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858826 - protein, 596 aa, Homo sapiens
MKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858827 - protein, 657 aa, Homo sapiens
MPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858828 - protein, 667 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858829 - protein, 621 aa, Homo sapiens
MLVKLVSNSPPQAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858830 - protein, 596 aa, Homo sapiens; identical to SEQ ID NO: 858826

SEQ ID NO: 858831 - protein, 432 aa, Homo sapiens
MKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858832 - protein, 596 aa, Homo sapiens; identical to SEQ ID NO: 858826

SEQ ID NO: 858833 - protein, 317 aa, Homo sapiens
MGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858834 - protein, 206 aa, Homo sapiens
MKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858835 - protein, 139 aa, Homo sapiens
MAFNYNSYPTDAEQELLSDDASSVSQIQSQTQSPQNVPEKLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858836 - protein, 452 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFLEASVHSSLIMPGHTWKQCYSNLHEYCLGLAEPPPNLFS

SEQ ID NO: 858837 - protein, 353 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVLYQPFILTRFSTMAFNKVHVFLV

SEQ ID NO: 858838 - protein, 111 aa, Homo sapiens
MSSDASQGVITTPPPPSMPHKERYFDRINENDPEYIRERNMSPDLRQDFNMMEQRKRVTQILQSPAFREDLECLIQEQMKKGHNPTVILALWEAKAGGSLEARSSRPAWAT

SEQ ID NO: 858839 - protein, 251 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISKESRHVTKTHLIINSPEGYSFFCKAYQLPSWLKVTYSYGAAVLDPGVLHLEQLAPSGMSRPPVCNLFARAWMVRVVVDHPYAFAHRGIP

SEQ ID NO: 858840 - protein, 674 aa, Homo sapiens; identical to SEQ ID NO: 858824

SEQ ID NO: 858841 - protein, 674 aa, Homo sapiens; identical to SEQ ID NO: 858824

SEQ ID NO: 858842 - protein, 432 aa, Homo sapiens; identical to SEQ ID NO: 858831

SEQ ID NO: 858843 - protein, 674 aa, Homo sapiens; identical to SEQ ID NO: 858824

SEQ ID NO: 858844 - protein, 674 aa, Homo sapiens; identical to SEQ ID NO: 858824

SEQ ID NO: 858845 - protein, 674 aa, Homo sapiens; identical to SEQ ID NO: 858824

SEQ ID NO: 858846 - protein, 620 aa, Homo sapiens [sequence omitted]

SEQ ID NO: 858847 - protein, 620 aa, Homo sapiens [sequence omitted]

SEQ ID NO: 858848 - protein, 326 aa, Homo sapiens
MSSDASRVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 858849 - protein, 247 aa, Homo sapiens [sequence omitted]

SEQ ID NO: 858850 - protein, 668 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITINPVMVVNGKDDMHDVEDELAKRVSRLSTSTTIVISMFS

SEQ ID NO: 858851 - protein, 426 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLVGCKIEVKLGFNVFRFKSRCFHFCRTCSILFQKLSLALGKHFIVI

SEQ ID NO: 858852 - protein, 328 aa, Homo sapiens [sequence omitted]

SEQ ID NO: 858853 - protein, 684 aa, Homo sapiens
MWVLLRSGYPLRILLPLRGEWMGRRGLPRNLAPGPPRRRYRKETLQALDMPVLPVTATEIRQYLRGHGIPFQDGHSCLRALSPFAESSQLKGQTGVTTSFSLFIDKTTGHFLCMTSLAEGSWEDFQASVEGRGDGAREGFLLSKAPEFEDSEEVRRIWNRAIPLWELPDQEEVQLADTMFGLTKVTDDTLKRFSVRYLRPARSLVFPWFSPGGSGLRGLKLLEAKCQGDGVSYEETTIPRPSAYHNLFGLPLISRRDAEVVLTSRELDSLALNQSTGLPTLTLPRGTTCLPPALLPYLEQFRRIVFWLGDDLRSWEAAKLFARKLNPKRCFLVRPGDQQPRPLEALNGGFNLSRILRTALPAWHKSIVSFRQLREEVLGELSNVEQAAGLRWSRFPDLNRILKGHRKGELTVFTGPTGSGKTTFISEYALDLCSQGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKASQEADNVLILQDRKLVTGPGKRYLQVSKNRFDGDVGVFPLEFNKNSLTFSIPPKNKARLKKIKDDTGPVAKKPSSGKKGATTQNSEICSGQAPTPDQPDTSKRSK

SEQ ID NO: 858854 - protein, 792 aa, Homo sapiens
MWVLLRSGYPLRILLPLRGEWMGRRGLPRNLAPGPPRRRYRKETLQALDMPVLPVTATEIRQYLRGHGIPFQDGHSCLRALSPFAESSQLKGQTGVTTSFSLFIDKTTGHFLCMTSLAEGSWEDFQASVEGRGDGAREGFLLSKAPEFEDSEEVRRIWNRAIPLWELPDQEEVQLADTMFGLTKVTDDTLKRFSVRYLRPARSLVFPWFSPGGSGLRGLKLLEAKCQGDGVSYEETTIPRPSAYHNLFGLPLISRRDAEVVLTSRELDSLALNQSTGLPTLTLPRGTTCLPPALLPYLEQFRRIVFWLGDDLRSWEAAKLFARKLNPKRCFLVRPGDQQPRPLEALNGGFNLSRILRTALPAWHKSIVSFRQLREEVLGELSNVEQAAGLRWSRFPDLNRILKGHRKGELTVFTGPTGSGKTTFISEYALDLCSQGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRDGDILSCLAGARLDIQHTLLRQLASRHTCCALLFSEMCAGTYHPHVYHMEVWGMAAGCMDRDLSVSPWVEGGRVGCGSLWGDVNGSRVCVCSCPSVSDKLFVLLGWRRIAAQDYIIGVFRKFATDNNCHVTLVIHPRKEDDDKELQTASIFGSAKASQEADNVLILQDRKLVTGPGKRYLQVSKNRFDGDVGVFPLEFNKNSLTFSIPPKNKARLKKIKDDTGPVAKKPSSGKKGATTQNSEICSGQAPTPDQPDTSKRSK

SEQ ID NO: 858855 - protein, 351 aa, Homo sapiens
LLHIATQSVVENAGQEAARSPARRHSYSLEAAEPKQRGEGGGTKPRGFRFRDDRSRSFASEVKRVACAGDSRCRRSGREKSGPTGSGKTTFISEYALDLCSQGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKASQEADNVLILQDRKLVTGPGKRYLQVSKNRFDGDVGVFPLEFNKNSLTFSIPPKNKARLKKIKDDTGPVAKKPSSGKKGATTQNSEICSGQAPTPDQPDTSKRSK

SEQ ID NO: 858856 - protein, 582 aa, Homo sapiens
MWVLLRSGYPLRILLPLRGEWMGRRGLPRNLAPGPPRRRYRKETLQALDMPVLPVTATEIRQYLRGHGIPFQDGHSCLRALSPFAESSQLKGQTGVTTSFSLFIDKTTGHFLCMTSLAEGSWEDFQASVEGRGDGAREGFLLSKAPEFEDSEEVRRIWNRAIPLWELPDQEEVQLADTMFGLTKVTDDTLKRFSVRYLRPARSLVFPWFSPGGSGLRGLKLLEAKCQGDGVSYEETTIPRPSAYHNLFGLPLISRRDAEVVLTSRELDSLALNQSTGLPTLTLPRGTTCLPPALLPYLEQFRRIVFWLGDDLRSWEAAKLFARKLNPKRCFLVRPGDQQPRPLEALNGGFNLSRILRTALPAWHKSIVSFRQLREEVLGELSNVEQAAGLRWSRFPDLNRILKGHRKGELTVFTGPTGSGKTTFISEYALDLCSQGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKVSGL

SEQ ID NO: 858857 - protein, 249 aa, Homo sapiens
LLHIATQSVVENAGQEAARSPARRHSYSLEAAEPKQRGEGGGTKPRGFRFRDDRSRSFASEVKRVACAGDSRCRRSGREKSGPTGSGKTTFISEYALDLCSQGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKVSGL

SEQ ID NO: 858858 - protein, 210 aa, Homo sapiens
LLHIATQSVVENAGQEAARSPARRHSYSLEAAEPKQRGEGGGTKPRGFRFRDDRSRSFASEVKGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKVSGL

SEQ ID NO: 858859 - protein, 82 aa, Homo sapiens
LLHIATQSVVENAGQEAARSPARRHSYSLEAAEPKQRGEGGGTKPRGFRFRDDRSRSFASEVKASSMCGRLTLPAKWEREKW

SEQ ID NO: 858860 - protein, 582 aa, Homo sapiens; identical to SEQ ID NO: 858856

SEQ ID NO: 858861 - protein, 230 aa, Homo sapiens
MLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKASQEADNVLILQDRKLVTGPGKRYLQVSKNRFDGDVGVFPLEFNKNSLTFSIPPKNKARLKKIKDDTGPVAKKPSSGKKGATTQNSEICSGQAPTPDQPDTSKRSK

SEQ ID NO: 858862 - protein, 582 aa, Homo sapiens; identical to SEQ ID NO: 858856

SEQ ID NO: 858863 - protein, 225 aa, Homo sapiens
MCAGTYHPHVYHMEVWGMAAGCMDRDLSVSPWVEGGRVGCGSLWGDVNGSRVCVCSCPSVSDKLFVLLGWRRIAAQDYIIGVFRKFATDNNCHVTLVIHPRKEDDDKELQTASIFGSAKASQEADNVLILQDRKLVTGPGKRYLQVSKNRFDGDVGVFPLEFNKNSLTFSIPPKNKARLKKIKDDTGPVAKKPSSGKKGATTQNSEICSGQAPTPDQPDTSKRSK

SEQ ID NO: 858864 - protein, 184 aa, Homo sapiens [sequence omitted]

SEQ ID NO: 858865 - protein, 351 aa, Homo sapiens; identical to SEQ ID NO: 858855

SEQ ID NO: 858866 - protein, 116 aa, Homo sapiens
MRKLFSFGRRLGQALLSSMDQEYAGPGYDIRDWELRKIHRAAIKGDAAEVERCLTRRFRDLDARDRKDRTVLHLACAHGRVQVVTLLLHRRCQIDICDRLNRTPLMKVYSSQLFQH

SEQ ID NO: 858867 - protein, 374 aa, Homo sapiens
MRKLFSFGRRLGQALLSSMDQEYAGPGYDIRDWELRKIHRAAIKGDAAEVERCLTRRFRDLDARDRKDRTVLHLACAHGRVQVVTLLLHRRCQIDICDRLNRTPLMKAVHSQEEACAIVLLECGANPNIEDIYGNTALHYAVYNKGTSLAERLLSHHANIEALNKEGNTPLLFAINSRRQHMVEFLLKNQANIHAVDNFKRTALILAVQHNLSSIVTLLLQQNIRISSQDMFGQTAEDYALCSDLRSIRQQILEHKNKMLKNHLRNDNQEAAAMKNESFKTQGASSKVSLYHQSGVQWHDLRLLQPSPPRFKQFSCLSLPRSWDNRHMRPCPETAAMKPANLKKRKERAKEHNLKVASEEKQERLQRSENKQPQ

SEQ ID NO: 858868 - protein, 32 aa, Homo sapiens
MLLTPQSLFWFPFISLTFLWGAAQSGHLRFDE

SEQ ID NO: 858869 - protein, 134 aa, Homo sapiens
GRAAILSLLGHLRRRRVPVTGVFLPHTPGRQGAPVRLQVIAVIGPSLGLGGSLPSPEVGHSTPGCWLWPCPRSAPLQDETGRAGGTGLGARPPSLQPRVPRQGAQLVRGLSFCPHQFSCVALVAFLGGRWGDVG

SEQ ID NO: 858870 - protein, 32 aa, Homo sapiens
MLLTPQSLFWFPFISLTFLWAAAQSGHLRFDE

SEQ ID NO: 858871 - protein, 120 aa, Homo sapiens
VLPPLTGHTKKISQHLSDRGEQWPSSSRQELLRSCAYRLYVMKNTQEDFVTVTCCFFCASVTSVGKRDFLLAPACWRSACLSFQSDPSISLLPEGKERWARQRTELEAVHLGNGTVRPYL

SEQ ID NO: 858872 - protein, 100 aa, Homo sapiens
IMASRGTVLIGEAEVEAGCGRRRQWRRRHGRACRGASWEPSPTRNPVRLTCSSTRKMYQPMMSSSAEAAATAAMVPRMDPCCLGDPGLTAREHSGSAPGE

SEQ ID NO: 858873 - protein, 112 aa, Homo sapiens
KDTPSSHHDWGASAEPGDHHGLIWATSEKHGSGWSFRDAGGTLGLEEGRVFVLPCIQQIQRISLNTLTLNVKSEKVYTRHGVPISVTGIAQVKIQGGRNKGDVGRPQYFPFS

SEQ ID NO: 858874 - protein, 184 aa, Homo sapiens
IHALVSSPYCRAAGGREFTSDYETARIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVRSQVGAEENC

SEQ ID NO: 858875 - protein, 207 aa, Homo sapiens
MTSRSTPAEHRLTWPISFRWPVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 858876 - protein, 207 aa, Homo sapiens; identical to SEQ ID NO: 858875

SEQ ID NO: 858877 - protein, 207 aa, Homo sapiens; identical to SEQ ID NO: 858875

SEQ ID NO: 858878 - protein, 207 aa, Homo sapiens; identical to SEQ ID NO: 858875

SEQ ID NO: 858879 - protein, 168 aa, Homo sapiens
MLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVASGQD

SEQ ID NO: 858880 - protein, 207 aa, Homo sapiens; identical to SEQ ID NO: 858875

SEQ ID NO: 858881 - protein, 201 aa, Homo sapiens
MTSRSTPAEHRLTWPISFRWPQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 858882 - protein, 207 aa, Homo sapiens; identical to SEQ ID NO: 858875

SEQ ID NO: 858883 - protein, 207 aa, Homo sapiens; identical to SEQ ID NO: 858875

SEQ ID NO: 858884 - protein, 209 aa, Homo sapiens
MTSRSTPAEHRLTWPISFRWPVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVRSQVGAEENC

SEQ ID NO: 858885 - protein, 177 aa, Homo sapiens
MLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVASGRGDQWSLDFSQ

SEQ ID NO: 858886 - protein, 177 aa, Homo sapiens; identical to SEQ ID NO: 858885

SEQ ID NO: 858887 - protein, 168 aa, Homo sapiens; identical to SEQ ID NO: 858879

SEQ ID NO: 858888 - protein, 183 aa, Homo sapiens
MLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVATKTTQMRTRSVRDDTMDPL

SEQ ID NO: 858889 - protein, 172 aa, Homo sapiens
MLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYGSTGHSNSPARECGKTHRREHLPGESQAFENSLSLQPSQMPSLIAEVA

SEQ ID NO: 858890 - protein, 128 aa, Homo sapiens
MFFTCGPNEAMVVSGFCRSPPVMVAGGRVFVLPCIQQIQRISLNTLTLNVKSEKVYTRHGVPISVTGIAQVKLSEPFPHSPLPHHPLSQTLRHLLATVFSTLACREVPLLVSSFPGTPRHLPPPPFFP

SEQ ID NO: 858891 - protein, 112 aa, Homo sapiens
MFFTCGPNEAMVVSGFCRSPPVMVAGGRVFVLPCIQQIQRISLNTLTLNVKSEKVYTRHGVPISVTGIAQVKLSEPFPHSPLPHHPLSQTLRHLLATTIWKDVKMRGAQGPH

SEQ ID NO: 858892 - protein, 75 aa, Homo sapiens
GVGALEDPRWPVAEEISGPLTSANKITLVSSGSGTMGAAKVTGEVLDILTRLPESVERLTGVSISQVNHKPLRTA

SEQ ID NO: 858893 - protein, 207 aa, Homo sapiens; identical to SEQ ID NO: 858875

SEQ ID NO: 858894 - protein, 247 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVASGQD

SEQ ID NO: 858895 - protein, 207 aa, Homo sapiens; identical to SEQ ID NO: 858875

SEQ ID NO: 858896 - protein, 168 aa, Homo sapiens; identical to SEQ ID NO: 858879

SEQ ID NO: 858897 - protein, 340 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVATRAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 858898 - protein, 256 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVASGRGDQWSLDFSQ

SEQ ID NO: 858899 - protein, 168 aa, Homo sapiens; identical to SEQ ID NO: 858879

SEQ ID NO: 858900 - protein, 75 aa, Homo sapiens; identical to SEQ ID NO: 858892

SEQ ID NO: 858901 - protein, 249 aa, Homo sapiens
MLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIRKLKPTMGGTHRGVCSMYLFGKGKFPGTAMGPRAQRDYELKKAAYDIEVNTRRAQADLAYQLQVATFWGPPYSKRLQVAKTKQQIEEQRVQVQVVERAQQVAVQEQEEVLDILTRLPESVERLTGVSISQVNHKPLRTA

SEQ ID NO: 858902 - protein, 128 aa, Homo sapiens; identical to SEQ ID NO: 858890

SEQ ID NO: 858903 - protein, 86 aa, Homo sapiens
VLSGGCCLIGDFLFLMISVNLTSILNPQMRGEAEAFAIGARARAEAEQMAKKAEAFQLYQEAAQLDMLLEKLPQVWRSCGHQERRK

SEQ ID NO: 858904 - protein, 185 aa, Homo sapiens
KSESMGLWECEGSGSAPPDASTGASAAQSPVSDYRACTDGHSKKDVPVPYSLAMAKGFSTSILPQSAMITSFRGLSRLSVLVLSTFSGPARGKGAQRCCQVARMELFDFGTCAQPRRSRRSRSISTRSARGPTMGAGLDVWQLIPTGWSVEGAQPSPSGTSDPPHPPPSSPSGRHRSTSPSTRTW

SEQ ID NO: 858905 - protein, 341 aa, Homo sapiens
MERAVPLAVPLGQTEVFQALQRLHMTIFSQSVSPCGKFLAAGNNYGQIAIFSLSSALSSEAKEESKKPVVTFQAHDGPVYSMVSTDRHLLSAGDGEVKAWLWAEMLKKGCKELWRRQPPYRTSLEVPEINALLLVPKENSLILAGGDCQLHTMDLETGTFTRVLRGHTDYIHCLALRERSPEVLSGGEDGAVRLWDLRTAKEVQTIEVYKHEECSRPHNGRWIGCLATDSDWMVCGGGPALTLWHLRSSTPTTIFPIRAPQKHVTFYQDLILSAGQGRCVNQWQLSGELKAQVPGSSPGLLSLSLNQQPAAPECKVLTAAGNSCRVDVFTNLGYRAFSLSF

SEQ ID NO: 858906 - protein, 341 aa, Homo sapiens; identical to SEQ ID NO: 858905

SEQ ID NO: 858907 - protein, 281 aa, Homo sapiens
MERAVPLAVPLGQTEVFQALQRLHMTIFSQSVSPCGKFLAAGNNYGQIAIFSLSSALSSEAKEESKKPVVTFQAHDGPVYSMVSTDRHLLSAGDGEVKAWLWAEMLKKGCKELWRRQPPYRTSLEVPEINALLLVPKENSLILAGGDCQLHTMDLETGTFTRVLRGHTDYIHCLALRERSPEVLSGGEDGAVRLWEPMMALSIASVSTDRHLLSAGDGEMKAWLWDGDAQEGLEGAVASSASHTGPAWKCLRSTALLLVPKENSIILAGGDCQKHVTFSDT

SEQ ID NO: 858908 - protein, 260 aa, Homo sapiens [sequence omitted]

SEQ ID NO: 858909 - protein, 260 aa, Homo sapiens [sequence omitted]

SEQ ID NO: 858910 - protein, 332 aa, Homo sapiens
MERAVPLAVPLGQTEVFQALQRLHMTIFSQSVSPCGKFLAAGNNYGQIAIFSLSSALSSEAKEETHDGPVYSMVSTDRHLLSAGDGEVKAWLWAEMLKKGCKELWRRQPPYRTSLEVPEINALLLVPKENSLILAGGDCQLHTMDLETGTFTRVLRGHTDYIHCLALRERSPEVLSGGEDGAVRLWDLRTAKEVQTIEVYKHEECSRPHNGRWIGCLATDSDWMVCGGGPALTLWHLRSSTPTTIFPIRAPQKHVTFYQDLILSAGQGRCVNQWQLSGELKAQVPGSSPGLLSLSLNQQPAAPECKVLTAAGNSCRVDVFTNLGYRAFSLSF

SEQ ID NO: 858911 - protein, 369 aa, Homo sapiens
MERAVPLAVPLGQTEVFQALQRLHMTIFSQSVSPCGKFLAAGNNYGQIAIFSLSSALSSEAKEESKKPVVTFQAHDGPVYSMVSTDRHLLSAGDGEVKAWLWAEMLKKVRSRAWERAGVPGPRESLGGHLVLSLLKGCKELWRRQPPYRTSLEVPEINALLLVPKENSLILAGGDCQLHTMDLETGTFTRVLRGHTDYIHCLALRERSPEVLSGGEDGAVRLWDLRTAKEVQTIEVYKHEECSRPHNGRWIGCLATDSDWMVCGGGPALTLWHLRSSTPTTIFPIRAPQKHVTFYQDLILSAGQGRCVNQWQLSGELKAQVPGSSPGLLSLSLNQQPAAPECKVLTAAGNSCRVDVFTNLGYRAFSLSF

SEQ ID NO: 858912 - protein, 199 aa, Homo sapiens
MERAVPLAVPLGQTEVFQALQRLHMTIFSQSVSPCGKFLAAGNNYGQIAIFSLSSALSSEAKEESKKPVVTFQAHDGPVYSMVSTDRHLLSAGDGEVKAWLWAEMLKKGCKELWRRQPPYRTSLEVPEINALLLVPKDTPSQLRVLECFSFSFFFFFYNKVSGFFTMLFLSMNGGQIGGVIYILLCPILIHKYPAPSLP

SEQ ID NO: 858913 - protein, 189 aa, Homo sapiens [sequence omitted]

SEQ ID NO: 858914 - protein, 166 aa, Homo sapiens
DRLVAPRKDQVARMELFDFGDLRTAKEVQTIEVYKHEECSRPHNGRWIGCLATDSDWMVCGGGPALTLWHLRSSTPTTIFPIRAPQKHVTFYQDLILSAGQGRCVNQWQLSGELKAQVPGSSPGLLSLSLNQQPAAPECKVLTAAGNSCRVDVFTNLGYRAFSLSF

SEQ ID NO: 858915 - protein, 341 aa, Homo sapiens; identical to SEQ ID NO: 858905

SEQ ID NO: 858916 - protein, 341 aa, Homo sapiens; identical to SEQ ID NO: 858905

SEQ ID NO: 858917 - protein, 341 aa, Homo sapiens; identical to SEQ ID NO: 858905

SEQ ID NO: 858918 - protein, 347 aa, Homo sapiens
MERAVPLAVPLGQTEVFQALQRLHMTIFSQSVSPCGKFLAAGNNYGQIAIFSLSSALSSEAKEESKKPVVTFQVLHFSLAHDGPVYSMVSTDRHLLSAGDGEVKAWLWAEMLKKGCKELWRRQPPYRTSLEVPEINALLLVPKENSLILAGGDCQLHTMDLETGTFTRVLRGHTDYIHCLALRERSPEVLSGGEDGAVRLWDLRTAKEVQTIEVYKHEECSRPHNGRWIGCLATDSDWMVCGGGPALTLWHLRSSTPTTIFPIRAPQKHVTFYQDLILSAGQGRCVNQWQLSGELKAQVPGSSPGLLSLSLNQQPAAPECKVLTAAGNSCRVDVFTNLGYRAFSLSF

SEQ ID NO: 858919 - protein, 347 aa, Homo sapiens; identical to SEQ ID NO: 858918

SEQ ID NO: 858920 - protein, 189 aa, Homo sapiens [sequence omitted]

SEQ ID NO: 858921 - protein, 211 aa, Homo sapiens
PHPAPPQENSLILAGGDCQLHTMDLETGTFTRVLRGHTDYIHCLALRERSPEVLSGGEDGAVRLWDLRTAKEVQTIEVYKHEECSRPHNGRWIGCLATDSDWMVCGGGPALTLWHLRSSTPTTIFPIRAPQKHVTFYQDLILSAGQGRCVNQWQLSGELKAQVPGSSPGLLSLSLNQQPAAPECKVLTAAGNSCRVDVFTNLGYRAFSLSF

SEQ ID NO: 858922 - protein, 559 aa, Homo sapiens
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 858923 - protein, 559 aa, Homo sapiens; identical to SEQ ID NO: 858922

SEQ ID NO: 858924 - protein, 499 aa, Homo sapiens [sequence omitted]

SEQ ID NO: 858925 - protein, 559 aa, Homo sapiens; identical to SEQ ID NO: 858922

SEQ ID NO: 858926 - protein, 541 aa, Homo sapiens
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARFECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 858927 - protein, 399 aa, Homo sapiens
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNKCYKGRLWRYIVKSWSKTQTTMQTFFLVPREYIS

SEQ ID NO: 858928 - protein, 114 aa, Homo sapiens
MARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 858929 - protein, 559 aa, Homo sapiens; identical to SEQ ID NO: 858922

SEQ ID NO: 858930 - protein, 559 aa, Homo sapiens; identical to SEQ ID NO: 858922

SEQ ID NO: 858931 - protein, 559 aa, Homo sapiens; identical to SEQ ID NO: 858922

SEQ ID NO: 858932 - protein, 280 aa, Homo sapiens
VHFSYGEQDRRKGDHLAFRHSSSFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 858933 - protein, 361 aa, Homo sapiens
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGWRLQ

SEQ ID NO: 858934 - protein, 124 aa, Homo sapiens
REGHRGLRSAGSGFQLPTTQTSTGVRGAGRPPPDSGPRVGNVSARKLAEWFFGWRLNLASLRRPSPANAYPASTGGCAVPLVTVITVHGRLRIPTPCSEEGSEATPACGVGGRASGTPEGVVAR

SEQ ID NO: 858935 - protein, 99 aa, Homo sapiens
REGHRGLRSAGSGFQLPTTQTSTGVRGAGRPPPDSGPRVGNNNFGPPGVYARYEVYLCPPSSSKDGHVNKFRHCDDCHKKQHYEVECKRITLAAAGAGG

SEQ ID NO: 858936 - protein, 124 aa, Homo sapiens; identical to SEQ ID NO: 858934

SEQ ID NO: 858937 - protein, 152 aa, Homo sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 858938 - protein, 121 aa, Homo sapiens
YRLVRGWCLNRPWEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 858939 - protein, 152 aa, Homo sapiens; identical to SEQ ID NO: 858937

SEQ ID NO: 858940 - protein, 152 aa, Homo sapiens; identical to SEQ ID NO: 858937

SEQ ID NO: 858941 - protein, 188 aa, Homo sapiens
AEAFRACKCCEPRGSRARFGCWRLQPEFKPKQLEGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 858942 - protein, 188 aa, Homo sapiens; identical to SEQ ID NO: 858941

SEQ ID NO: 858943 - protein, 188 aa, Homo sapiens; identical to SEQ ID NO: 858941

SEQ ID NO: 858944 - protein, 188 aa, Homo sapiens; identical to SEQ ID NO: 858941

SEQ ID NO: 858945 - protein, 190 aa, Homo sapiens
SARYEAGCLKCCEPRGSRARFGCWRLQPEFKPKQLEGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 858946 - protein, 177 aa, Homo sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 858947 - protein, 177 aa, Homo sapiens; identical to SEQ ID NO: 858946

SEQ ID NO: 858948 - protein, 177 aa, Homo sapiens; identical to SEQ ID NO: 858946

SEQ ID NO: 858949 - protein, 177 aa, Homo sapiens; identical to SEQ ID NO: 858946

SEQ ID NO: 858950 - protein, 188 aa, Homo sapiens; identical to SEQ ID NO: 858941

SEQ ID NO: 858951 - protein, 129 aa, Homo sapiens
MELNLFHRRESNLNSITNFTAEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 858952 - protein, 89 aa, Homo sapiens
AAYGADMAKSKNHTTHNQSRKWHRNGIKKPRSQRYESLKGVDPKFLRNMLLAKKHNKKGLKKMQANNAKAMSARAEAIKALVKPKEVSP

SEQ ID NO: 858953 - protein, 190 aa, Homo sapiens; identical to SEQ ID NO: 858945

SEQ ID NO: 858954 - protein, 188 aa, Homo sapiens; identical to SEQ ID NO: 858941

SEQ ID NO: 858955 - protein, 188 aa, Homo sapiens; identical to SEQ ID NO: 858941

SEQ ID NO: 858956 - protein, 188 aa, Homo sapiens; identical to SEQ ID NO: 858941

SEQ ID NO: 858957 - protein, 177 aa, Homo sapiens; identical to SEQ ID NO: 858946

SEQ ID NO: 858958 - protein, 177 aa, Homo sapiens; identical to SEQ ID NO: 858946

SEQ ID NO: 858959 - protein, 177 aa, Homo sapiens; identical to SEQ ID NO: 858946

SEQ ID NO: 858960 - protein, 150 aa, Homo sapiens
AEAFRACKCCEPRGSRARFGCWRLQPEFKPKQLEGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGR

SEQ ID NO: 858961 - protein, 606 aa, Homo sapiens [sequence omitted]

SEQ ID NO: 858962 - protein, 186 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPR

SEQ ID NO: 858963 - protein, 418 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPSPRTQHCDPEHVPPISPGPAQVLRAYRRSADFRRAARQQSICVSQHRPPHGTHKLIQAHMAPGVFSSLMLPGKIERGSDGKPPHGGRHPKHTAKAAVPRGARKRSPTICHKRSTQGTRAKAAERAHTSMGAEETRDPTHVATKTLDAVNTSELTRATLTREGNPPPKLEEVAQLRLRTKDSRGTRSGRVGDTSSYQEGTRARIGRHVGPAKRSPHTRVPTPQQVRQAPGLSNH

SEQ ID NO: 858964 - protein, 48 aa, Homo sapiens
AAAYYYYCSEFKLLTMYGPMWILGGPFCVSPAIQGLLSFFTKKHRILL

SEQ ID NO: 858965 - protein, 643 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQGAQPGVGGGMGSTEAQPRGPYRQLTVSPCFIPFMPSRFYHSVQDLSGGSRQHEAPSNRPLNELLTPQGPSPRTQHCDPEHFPFPAPANAPLQRIRSTSTPNVHMVSTTAPMDSNLIQLTGQSFSTDAAGSRGGSDGTPRGSPSPASVSSGRKSPHSKSPAEQRERKSLADDKKKVKNLGYRDSGYYWEVPPSEVQLLKRIGTGSFGTVFRGRWHGDVAVKVLKVSQPTAEQAQAFKNEMQVLRKTRHVNILLFMGFMTRPGFAIITQWCEGSSLYHHLHVADTRFDMVQLIDVARQTAQGMDYLHAKNIIHRDLKSNNIFLHEGLTVKIGDFGLATVKTRWSGAQPLEQPSGSVLWMAAEVIRMQDPNPYSFQSDVYAYGVVLYELMTGSLPYSHIGCRDQIIFMVGRGYLSPDLSKISSNCPKAMRRLLSDCLKFQREERPLFPQILATIELLQRSLPKIERSASEPSLHRTQADELPACLLSAARLVP

SEQ ID NO: 858966 - protein, 571 aa, Homo sapiens
MLGALKIPQTVLAVASTLYFSIGCRTMYEVTLVLRGSATDANMNPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPSPRTQHCDPEHFPFPAPANAPLQRIRSTSTPNVHMVSTTAPMDSNLIQLTGQSFSTDAAGSRGGSDGTPRGSPSPASVSSGRKSPHSKSPAEQRERKSLADDKKKVKNLGYRDSGYYWEVPPSEVQLLKRIGTGSFGTVFRGRWHGDVAVKVLKVSQPTAEQAQAFKNEMQVLRKTRHVNILLFMGFMTRPGFAIITQWCEGSSLYHHLHVADTRFDMVQLIDVARQTAQGMDYLHAKNIIHRDLKSNNIFLHEGLTVKIGDFGLATVKTRWSGAQPLEQPSGSVLWMAAEVIRMQDPNPYSFQSDVYAYGVVLYELMTGSLPYSHIGCRDQIIFMVGRGYLSPDLSKISSNCPKAMRRLLSDCLKFQREERPLFPQILATIELLQRSLPKIERSASEPSLHRTQADELPACLLSAARLVP

SEQ ID NO: 858967 - protein, 395 aa, Homo sapiens
RTRHSNWDFSSPTAPMDSNLIQLTGQSFSTDAAGSRGGSDGTPRGSPSPASVSSGRKSPHSKSPAEQRERKSLADDKKKVKNLGYRDSGYYWEVPPSEVQLLKRIGTGSFGTVFRGRWHGDVAVKVLKVSQPTAEQAQAFKNEMQVLRKTRHVNILLFMGFMTRPGFAIITQWCEGSSLYHHLHVADTRFDMVQLIDVARQTAQGMDYLHAKNIIHRDLKSNNIFLHEGLTVKIGDFGLATVKTRWSGAQPLEQPSGSVLWMAAEVIRMQDPNPYSFQSDVYAYGVVLYELMTGSLPYSHIGCRDQIIFMVGRGYLSPDLSKISSNCPKAMRRLLSDCLKFQREERPLFPQILATIELLQRSLPKIERSASEPSLHRTQADELPACLLSAARLVP

SEQ ID NO: 858968 - protein, 533 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPSPRTQHCDPEHFPFPAPANAPLQRIRSTSTPNVHMVSTTAPMDSNLIQLTGQSFSTDAAGSRGGSDGTPRGSPSPASVSSGRKSPHSKSPAEQRERKSLADDKKKVKNLGYRDSGYYWEVPPSEVQLLKRIGTGSFGTVFRGRWHGDVAVKVLKVSQPTAEQAQAFKNEMQVLRKTRHVNILLFMGFMTRPGFAIITQWCEGSSLYHHLHVADTRFDMVQLIDVARQTAQGMDYLHAKNIIHRDLKSNNIFLHEGLTVKIGDFGLATVKTRWSGAQPLEQPSGSVLWMAAEVIRMQDTYGQVILIIAHVLTSSISIRPSKLNLRTHSQSHIILSQGHECSGTELNCIL

SEQ ID NO: 858969 - protein, 241 aa, Homo sapiens
KFQREERPLFPQILATIELLQRSLPKIERSASEPSLHRTQADEFLPAYSAQPALCLRPRPSHQGANLSPPRQGALPTSQSMFVSALMLPQDPPFTQPLEQPSGSVLWMAAEVIRMQDPNPYSFQSDVYAYGVVLYELMTGSLPYSHIGCRDQIIFMVGRGYLSPDLSKISSNCPKAMRRLLSDCLKFQREERPLFPQILATIELLQRSLPKIERSASEPSLHRTQADELPACLLSAARLVP

SEQ ID NO: 858970 - protein, 418 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPSPRTQHCDPEHVPPISPGPAQVLRAYRRSADFHVQLANSPYVSANTGPPMELTSSSKLTWHQEFSAPDAARKIERGSDGKPPHGGRHPKHTAKAAVPRGARKRSPTICHKRSTQGTRAKAAERAHTSMGAEETRDPTHVATKTLDAVNTSELTRATLTREGNPPPKLEEVAQLRLRTKDSRGTRSGRVGDTSSYQEGTRARIGRHVGPAKRSPHTRVPTPQQVRQAPGLSNHW

SEQ ID NO: 858971 - protein, 186 aa, Homo sapiens; identical to SEQ ID NO: 858962

SEQ ID NO: 858972 - protein, 186 aa, Homo sapiens; identical to SEQ ID NO: 858962

SEQ ID NO: 858973 - protein, 137 aa, Homo sapiens
GTNGNLPGRVRGMAIRSPCSGSLTLADIFLHEGLTVKIGDFGLATVKTRWSGAQPLEQPSGSVLWMAAEVIRMQDPNPYSFQSDVYAYGVVLYELMTGSLPYSHIGCRDQVSPTPYPQFPGLRDPLRHPYPTSPPLH

SEQ ID NO: 858974 - protein, 748 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPSPRTQHCDPEHFPFPAPANAPLQRIRSTSTPNVHMVSTTAPMDSNLIQLTGQSFSTDAAGSRGGSDGTPRGSPSPASVSSGRKSPHSKSPAEQRERKSLADDKKKVKNLGYRDSGYYWEVPPSEVQLLKRIGTGSFGTVFRGRWHGDVAVKVLKVSQPTAEQAQAFKNEMQVLRKTRHVNILLFMGFMTRPGFAIITQWCEGSSLYHHLHVADTRFDMVQLIDVARQTAQGMDYLHAKNIIHRDLKSNNIFLHEGLTVKIGDFGLATVKTRWSGAQPLEQPSGSVLWMAAEVIRMQDPNPYSFQSDVYAYGVVLYELMTGSLPYSHIGCRDQIIFMVGRGYLSPDLSKISSNCPKAMRRLLSDCLKFQREERPLFPQGHSPRLSGVPRNPPCTAPRPMSCLPAYSAQPALCLRPRPSHQGANLSPPRQGALPTSQSMFVSALMLPQDPPFPTLGDEGVPMCFSSSSGIGGPPPKTEPPVSSIIWFPLGFGDTSKFWELLHLQWLGFVAGIPLRTSLEFVPDVPSTGFWGSQHPMWILGGPFCVSPAIQGLLSFFTKKHRILLG

SEQ ID NO: 858975 - protein, 606 aa, Homo sapiens [sequence omitted]

SEQ ID NO: 858976 - protein, 544 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPSPRTQHCDPEHFPFPAPANAPLQRIRSTSTPNVHMVSTTAPMDSNLIQLTGQSFSTDAAGSRGGSDGTPRGSPSPASVSSGRKSPHSKSPAEQRERKSLADDKKKVKNLGYRDSGYYWEVPPSEVQLLKRIGTGSFGTVFRGRWHGDVAVKVLKVSQPTAEQAQAFKNEMQVLRKTRHVNILLFMGFMTRPGFAIITQWCEGSSLYHHLHVADTRFDMVQLIDVARQTAQGMDYLHAKNIIHRDLKSNNIFLHEGLTVKIGDFGLATVKTRWSGAQPLEQPSGSVLWMAAEVIRMQDPNPYSFQSDVYAYGVVLYELMTGSLPYSHIGCRDQVSPTPYPQFPGLRDPLRHPYPTSPPLH

SEQ ID NO: 858977 - protein, 134 aa, Homo sapiens [sequence omitted]

SEQ ID NO: 858978 - protein, 127 aa, Homo sapiens [sequence omitted]

SEQ ID NO: 858979 - protein, 103 aa, Homo sapiens
TQPGPHQQVLTSTRDFLCELTPTPLYRISPALHLSCSVQPHPLYLSSATLVTILPWDLCTCCVLHPEHKHHHSLRVSSCPLAEAHAAGRACQAERIAHTKALS

SEQ ID NO: 858980 - protein, 107 aa, Homo sapiens
DLVAVDLQWSKPTSGFFPRLPTNLPSCCGEMSLPSTSSVKISRPFGMGSASISRRCLHSKSSLLSSLVSVSVDNWSLFRANSDLGSPFSRAFFNPLGTVVFPSVHSA

SEQ ID NO: 858981 - protein, 113 aa, Homo sapiens
MEGRVQLMKALLARPLRPAARRWRNPIPFPETFDGDTDRLPEFIVQTSSYMFVDENTFSNDALKVTFLITRLTGPALQWVIPYIKKESPLLSDYRGFLAEMKRVFGWEEDEDF

SEQ ID NO: 858982 - protein, 141 aa, Homo sapiens
MKPLPCPYRGGGLGHQGMRYWGDLKAWELGISISSKTTGPLHSCHLEFLGELNVCSLKCVPCSVEVESGKGSNREGCPQLSGDFRREGAAAGLVPSSRVEISKGLHLCYPWEGKDRTTPSVFLDIRDHKSGFQWFLDRVSL

SEQ ID NO: 858983 - protein, 547 aa, Homo sapiens
MTKTDPAPMAPPPRGEEEEEEEEDEPVPEAPSPTQERRQKPVVHPSAPAPLPKDYAFTFFDPNDPACQEILFDPQTTIPELFAIVRQWVPQVQHKIDVIGNEILRRGCHVNDRDGLTDMTLLHYACKAGAHGVGDPAAAVRLSQQLLALGADVTLRSRWTNMNALHYAAYFDVPDLVRVLLKGARPRVVNSTCSDFNHGSALHIAASSLCLGAAKCLLEHGANPALRNRKGQVPAEVVPDPMDMSLDKAEAALVAKELRTLLEEAVPLSCALPKVTLPNYDNVPGNLMLSALGLRLGDRVLLDGQKTGTLRFCGTTEFASGQWVGVELDEPEGKNDGSVGGVRYFICPPKQGLFASVSKISKAVDAPPSSVTSTPRTPRMDFSRVTGKGRREHKGKKKTPSSPSLGSLQQRDGAKAEVGDQVLVAGQKQGIVRFYGKTDFAPGYWYGIELDQPTGKHDGSVFGVRYFTCPPRHGVFAPASRIQRIGGSTDSPGDSVGAKKVHQVTMTQPKRTFTTVRTPKDIASENSISRLLFCCWFPWMLRAEMQS

SEQ ID NO: 858984 - protein, 649 aa, Homo sapiens
LSAPTPCRRLGLVPFSLSPLPPPSRPLTPTPHCSHSLPSLHFGPQRCLPEIQLRGGHPGPWKLLGAWTLEPAGHPLQLTSASRICLKAAPNSAPAPRGPPRTMTKTDPAPMAPPPRGEEEEEEEEDEPVPEAPSPTQERRQKPVVHPSAPAPLPKDYAFTFFDPNDPACQEILFDPQTTIPELFAIVRQWVPQVQHKIDVIGNEILRRGCHVNDRDGLTDMTLLHYACKAGAHGVGDPAAAVRLSQQLLALGADVTLRSRWTNMNALHYAAYFDVPDLVRVLLKGARPRVVNSTCSDFNHGSALHIAASSLCLGAAKCLLEHGANPALRNRKGQVPAEVVPDPMDMSLDKAEAALVAKELRTLLEEAVPLSCALPKVTLPNYDNVPGNLMLSALGLRLGDRVLLDGQKTGTLRFCGTTEFASGQWVGVELDEPEGKNDGSVGGVRYFICPPKQGLFASVSKISKAVDAPPSSVTSTPRTPRMDFSRVTGKGRREHKGKKKTPSSPSLGSLQQRDGAKAEVGDQVLVAGQKQGIVRFYGKTDFAPGYWYGIELDQPTGKHDGSVFGVRYFTCPPRHGVFAPASRIQRIGGSTDSPGDSVGAKKVHQVTMTQPKRTFTTVRTPKDIASENSISRLLFCCWFPWMLRAEMQS

SEQ ID NO: 858985 - protein, 520 aa, Homo sapiens
MAKTYSSPTEAGRRGSVAWGDLGPLATPAFTFFDPNDPACQEILFDPQTTIPELFAIVRQWVPQVQHKIDVIGNEILRRGCHVNDRDGLTDMTLLHYACKAGAHGVGDPAAAVRLSQQLLALGADVTLRSRWTNMNALHYAAYFDVPDLVRVLLKGARPRVVNSTCSDFNHGSALHIAASSLCLGAAKCLLEHGANPALRNRKGQVPAEVVPDPMDMSLDKAEAALVAKELRTLLEEAVPLSCALPKVTLPNYDNVPGNLMLSALGLRLGDRVLLDGQKTGTLRFCGTTEFASGQWVGVELDEPEGKNDGSVGGVRYFICPPKQGLFASVSKISKAVDAPPSSVTSTPRTPRMDFSRVTGKGRREHKGKKKTPSSPSLGSLQQRDGAKAEVGDQVLVAGQKQGIVRFYGKTDFAPGYWYGIELDQPTGKHDGSVFGVRYFTCPPRHGVFAPASRIQRIGGSTDSPGDSVGAKKVHQVTMTQPKRTFTTVRTPKDIASENSISRLLFCCWFPWMLRAEMQS

SEQ ID NO: 858986 - protein, 547 aa, Homo sapiens; identical to SEQ ID NO: 858983

SEQ ID NO: 858987 - protein, 547 aa, Homo sapiens; identical to SEQ ID NO: 858983

SEQ ID NO: 858988 - protein, 547 aa, Homo sapiens; identical to SEQ ID NO: 858983

SEQ ID NO: 858989 - protein, 323 aa, Homo sapiens
MTKTDPAPMAPPPRGEEEEEEEEDEPVPEAPSPTQERRQKPVVHPSAPAPLPKDYAFTFFDPNDPACQEILFDPQTTIPELFAIVRQWVPQVQHKIDVIGNEILRRGCHVNDRDGLTDMTLLHYACKAGAHGVGDPAAAVRLSQQLLALGADVTLRSRWTNMNALHYAAYFDVPDLVRVLLKGARPRVVNSTCSDFNHGSALHIAASSLCLGAAKCLLEHGANPALRNRKGQVPAEVVPDPMDMSLDKAEAALVAKELRTLLEEAVPLSCALPKVTLPNYDNVPGNLMLSALGLRLGDRVLLDGQKVRGWDVCLHGGWGWDSA

SEQ ID NO: 858990 - protein, 102 aa, Homo sapiens
MAHCSLHIPGLSDPPLESGSCGPGTVARACHLSSLGGLVSGSLEATGPMQVQNQAERSGHLQSSKILTFGQAWRLKSVMSALCEAEMYGSLELRSWIPAWAR

SEQ ID NO: 858991 - protein, 102 aa, Homo sapiens
MESLSPRLECNSVIWAHCYVCLSGSSNSPASASQVAGITGAHHHTWLIFVFLVQMGFHHVGQAGLELLTSGDLPTSASQSAGITGVSYHTWPQISSSYKDTS

SEQ ID NO: 858992 - protein, 1426 aa, Homo sapiens
AVGWAREGTLQVKRWGRKRRRGATVSSRGLRPSAPIFPELESDPGLAGHPGKAGVIVQMETQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVPVSLPVTQ

SEQ ID NO: 858993 - protein, 938 aa, Homo sapiens
AVGWAREGTLQVKRWGRKRRRGATVSSRGLRPSAPIFPELESDPGLAGHPGKAGVIVQMETQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLVRINTFLSLFS

SEQ ID NO: 858994 - protein, 1005 aa, Homo sapiens
AVGWAREGTLQVKRWGRKRRRGATVSSRGLRPSAPIFPELESDPGLAGHPGKAGVIVQMETQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKVLVLIGISNSPFKAILEYLMK

SEQ ID NO: 858995 - protein, 1408 aa, Homo sapiens
AVGWAREGTLQVKRWGRKRRRGATVSSRGLRPSAPIFPELESDPGLAGHPGKAGVIVQMETQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVPVSLPVTQ

SEQ ID NO: 858996 - protein, 1422 aa, Homo sapiens
AVGWAREGTLQVKRWGRKRRRGATVSSRGLRPSAPIFPELESDPGLAGHPGKAGVIVQMETQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVDTLT

SEQ ID NO: 858997 - protein, 1417 aa, Homo sapiens
AVGWAREGTLQVKRWGRKRRRGATVSSRGLRPSAPIFPELESDPGLAGHPGKAGVIVQMETQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQ

SEQ ID NO: 858998 - protein, 1217 aa, Homo sapiens
AVGWAREGTLQVKRWGRKRRRGATVSSRGLRPSAPIFPELESDPGLAGHPGKAGVIVQMETQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPVS

SEQ ID NO: 858999 - protein, 1417 aa, Homo sapiens; identical to SEQ ID NO: 858997

SEQ ID NO: 859000 - protein, 430 aa, Homo sapiens
AVGWAREGTLQVKRWGRKRRRGATVSSRGLRPSAPIFPELESDPGLAGHPGKAGVIVQMETQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKVCTKSYGRSDFTC

SEQ ID NO: 859001 - protein, 318 aa, Homo sapiens
MWLPLLLGALLWAVLWLLRDRQSLPASNAFVFITGCDSGFGRLLALQLDQRGFRVLASCLTPSGAEDLQRVASSRLHTTLLDITDPQSVQQAAKWVEMHVKEAGLFGLVNNAGVAGIIGPTPWLTRDDFQRVLNVNTMGPIGVTLALLPLLQQARGRVINITSVLGRLAANGGGYCVSKFGLEAFSDSLRRDVAHFGIRVSIVEPGFFRTPVTNLESLEKTLQACWARLPPATQAHYGGAFLTKYLKMQQRIMNLICDPDLTKVSRCLEHALTARHPRTRYSPGWDAKLLWLPASYLPASLVDAVLTWVLPKPAQAVY

SEQ ID NO: 859002 - protein, 324 aa, Homo sapiens
RSSFRSRRGPGVPSPQPDVTMLSRLLKEHQAKQNERKELQEKRRREAITAATCLTEALVDHLNVGVAQAYMNQRKLDHEVKTLQVQAAQFAKQTGQWIGMVENFNQALKGLFGLVNNAGVAGIIGPTPWLTRDDFQRVLNVNTMGPIGVTLALLPLLQQARGRVINITSVLGRLAANGGGYCVSKFGLEAFSDSLRRDVAHFGIRVSIVEPGFFRTPVTNLESLEKTLQACWARLPPATQAHYGGAFLTKYLKMQQRIMNLICDPDLTKVSRCLEHALTARHPRTRYSPGWDAKLLWLPASYLPASLVDAVLTWVLPKPAQAVY

SEQ ID NO: 859003 - protein, 124 aa, Homo sapiens
CGKLKGQFEEKQFSDAPRKKRELWECLTYPQHPFHLPTGLFGLVNNAGVAGIIGPTPWLTRDDFQRVLNVNTMGPIGVTLALLPLLQQARGRVINITSVLGRLAANGGGYCVSKFGLEAFSDSL

SEQ ID NO: 859004 - protein, 92 aa, Homo sapiens
KMGWSEEGKLIATTYGAADLKMQQRIMNLICDPDLTKVSRCLEHALTARHPRTRYSPGWDAKLLWLPASYLPASLVDAVLTWVLPKPAQAVY

SEQ ID NO: 859005 - protein, 256 aa, Homo sapiens
DAWVDPRVGGVVLFPWQARLYDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSHVYWWRYCIRLENLDSDVVQLRERHWRIFSLSGTLETVRGRGVVGRVSILGLVILVLCGKPGGLAHGFLLLCCYRQRLTL

SEQ ID NO: 859006 - protein, 214 aa, Homo sapiens
CSELRGGTRRAKRAGTPRGAVWDWGGTPPGRGSGSVSAAGRALGRDMAACTARRALAVGSRWWSRSLTGARWPRPLCAAAGAGAFSPASTTTTRRHLSSRNRPEGKVLETVGVFEVPKQNGKYETGQLFLHSIFGYRGVVLFPWQARLYDRDVASAAPEKAENPAGHGSKEVKGKTHTYYQVLIDARDCPHIVSKQDGWAWGSSPWKVLHPNGD

SEQ ID NO: 859007 - protein, 414 aa, Homo sapiens
CSELRGGTRRAKRAGTPRGAVWDWGGTPPGRGSGSVSAAGRALGRDMAACTARRALAVGSRWWSRSLTGARWPRPLCAAAGAGAFSPASTTTTRRHLSSRNRPEGKVLETVGVFEVPKQNGKYETGQLFLHSIFGYRGVVLFPWQARLYDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSHVYWWRYCIRLENLDSDVVQLRERHWRIFSLSGTLETVRGRGVVGREPVLSKEQPAFQYSSHVSLQASSGHMWGTFRFERPDGSHFDVRIPPFSLESNKDEKTPPSGLHW

SEQ ID NO: 859008 - protein, 414 aa, Homo sapiens; identical to SEQ ID NO: 859007

SEQ ID NO: 859009 - protein, 414 aa, Homo sapiens; identical to SEQ ID NO: 859007

SEQ ID NO: 859010 - protein, 414 aa, Homo sapiens; identical to SEQ ID NO: 859007

SEQ ID NO: 859011 - protein, 414 aa, Homo sapiens; identical to SEQ ID NO: 859007

SEQ ID NO: 859012 - protein, 381 aa, Homo sapiens
DAWVDPRVGGGTPPGRGSGSVSAAGRALGRDMAACTARRALAVGSRWWSRSLTGARWPRPLCAAAGAGAFSPASTTTTRRHLSSRNRPEGKVLETVGVFEVPKQNGKYETGQLFLHSIFGYRGVVLFPWQARLYDRDVASAAPEKAENPAGHGSKEVKGSQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSHVYWWRYCIRLENLDSDVVQLRERHWRIFSLSGTLETVRGRGVVGREPVLSKEQPAFQYSSHVSLQASSGHMWGTFRFERPDGSHFDVRIPPFSLESNKDEKTPPSGLHW

SEQ ID NO: 859013 - protein, 260 aa, Homo sapiens
SQLFTGFCSPPRKEKPRCLAPESKILSVLINARNCPHFSQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSHVYWWRYCIRLENLDSDVVQLRERHWRIFSLSGTLETVRGRGVVGREPVLSKEQPAFQYSSHVSLQASSGHMWGTFRFERPDGSHFDVRIPPFSLESNKDEKTPPSGLHW

SEQ ID NO: 859014 - protein, 366 aa, Homo sapiens
CSELRGGTRRAKRAGTPRGAVWDWGGTPPGRGSGSVSAAGRALGRDMAACTARRALAVGSRWWSRSLTGARWPRPLCAAAGAGAFSPASTTTTRRHLSSRNRPEGKVLETVGVFEVPKQNGKYETGQLFLHSIFGYRGVVLFPWQARLYDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSHVYWWRYCIRLENLDSDVVQLRERHWRIFSLSGTLETVRGRGVVGRDRVSLCHPGWSAVVRP

SEQ ID NO: 859015 - protein, 384 aa, Homo sapiens
CSELRGGTRRAKRAGTPRGAVWDWGGTPPGRGSGSVSAAGRALGRDMAACTARRALAVGSRWWSRSLTGARWPRPLCAAAGAGAFSPASTTTTRRHLSSRNRPEGKVLETVGVFEVPKQNGKYETGQLFLHSIFGYRGVVLFPWQARLYDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSHVYWWRYCIRLENLDSDVVQLRERHWRIFSLSGTLETVRGRGVVGRVSILGLVILVLCGKPGGLAHGFLLLCCYRQRLTL

SEQ ID NO: 859016 - protein, 76 aa, Homo sapiens
WRYCIRLENLDSDVVQLRERHWRIFSLSGTLETVRGRGVVGRVSILGLVILVLCGKPGGLAHGFLLLCCYRQRLTL

SEQ ID NO: 859017 - protein, 357 aa, Homo sapiens
DAWVDPRVGGGTPPGRGSGSVSAAGRALGRDMAACTARRALAVGSRWWSRSLTGARWPRPLCAAAGAGAFSPASTTTTRRHLSSRNRPEGKVLETVGVFEVPKQNGKYETGQLFLHSIFGYRGVVLFPWQARLYDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSSGTGGLLNRWELERDVGQPGAAEGFGSGLGMAARFGGRSRGHVGGALIGQNAVRERTSAGQSTNGGGE

SEQ ID NO: 859018 - protein, 414 aa, Homo sapiens; identical to SEQ ID NO: 859007

SEQ ID NO: 859019 - protein, 399 aa, Homo sapiens
DAWVDPRVGGGTPPGRGSGSVSAAGRALGRDMAACTARRALAVGSRWWSRSLTGARWPRPLCAAAGAGAFSPASTTTTRRHLSSRNRPEGKVLETVGVFEVPKQNGKYETGQLFLHSIFGYRGVVLFPWQARLYDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSHVYWWRYCIRLENLDSDVVQLRERHWRIFSLSGTLETVRGRGVVGREPVLSKEQPAFQYSSHVSLQASSGHMWGTFRFERPDGSHFDVRIPPFSLESNKDEKTPPSGLHW

SEQ ID NO: 859020 - protein, 414 aa, Homo sapiens; identical to SEQ ID NO: 859007

SEQ ID NO: 859021 - protein, 414 aa, Homo sapiens; identical to SEQ ID NO: 859007

SEQ ID NO: 859022 - protein, 414 aa, Homo sapiens; identical to SEQ ID NO: 859007

SEQ ID NO: 859023 - protein, 414 aa, Homo sapiens; identical to SEQ ID NO: 859007

SEQ ID NO: 859024 - protein, 414 aa, Homo sapiens; identical to SEQ ID NO: 859007

SEQ ID NO: 859025 - protein, 414 aa, Homo sapiens; identical to SEQ ID NO: 859007

SEQ ID NO: 859026 - protein, 419 aa, Homo sapiens
CSELRGGTRRAKRAGTPRGAVWDWGGTPPGRGSGSVSAAGRALGRDMAACTARRALAVGSRWWSRSLTGARWPRPLCAAAGAGAFSPASTTTTRRHLSSRNRPEGKVLETVGVFEVPKQNGKYETGQLFLHSIFGYRGVVLFPWQARLYDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSGNQCYPRSSLRSSIAATSRCRLPVGTCGARSALKDLMAPTLMFGFLPSPWKAIKMRRHHPQAFTGRPAEAPSAQAWSPGRTTLIPQLLQNSSLPIMGHSGSLNLIVGFFLWGGVV

SEQ ID NO: 859027 - protein, 372 aa, Homo sapiens
CSELRGGTRRAKRAGTPRGAVWDWGGTPPGRGSGSVSAAGRALGRDMAACTARRALAVGSRWWSRSLTGARWPRPLCAAAGAGAFSPASTTTTRRHLSSRNRPEGKVLETVGVFEVPKQNGKYETGQLFLHSIFGYRGVVLFPWQARLYDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSSGTGGLLNRWELERDVGQPGAAEGFGSGLGMAARFGGRSRGHVGGALIGQNAVRERTSAGQSTNGGGE

SEQ ID NO: 859028 - protein, 159 aa, Homo sapiens
TATRPRSRGRGPGAHRPISGNMATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKVCLSILPLVLKSF

SEQ ID NO: 859029 - protein, 562 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSQVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGQGKGVEAGPDLLQ

SEQ ID NO: 859030 - protein, 623 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGVRGARGGRGGNVGGKRKADGYNQPDSKRRQTNNQNWGSQPIAQQPLQGGDHSGNYGYKSENQEFYQDTFGQQWK

SEQ ID NO: 859031 - protein, 562 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGQGKGVEAGPDLLQ

SEQ ID NO: 859032 - protein, 562 aa, Homo sapiens; identical to SEQ ID NO: 859031

SEQ ID NO: 859033 - protein, 562 aa, Homo sapiens; identical to SEQ ID NO: 859031

SEQ ID NO: 859034 - protein, 605 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGVRGARGGRGGNVGGKRKADGYNQPDSKRRQTNNQNWGSQPIAQQPLQAGKRGRGRS

SEQ ID NO: 859035 - protein, 355 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQVKVLFVRNLANTVTEEILEKAFSQFGKLERVKKLKDYAFIHFDERDGAVKLWKK

SEQ ID NO: 859036 - protein, 298 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVIYTTNRETEKNRRLLSGYESNTASS

SEQ ID NO: 859037 - protein, 182 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEFVGEKIPRDLFEGVNFVST

SEQ ID NO: 859038 - protein, 562 aa, Homo sapiens; identical to SEQ ID NO: 859031

SEQ ID NO: 859039 - protein, 154 aa, Homo sapiens
HEEREREREKEQQKIKCMTITTIMVHLICPLQQEVEGVEVEVVMDILQIIMDMKIIMIIMVMITITIVVDMKIHTMVMKIFKLELEEGVVEEQGVLLHPEVVGLLLPAVEPVIHREEVLDQQEAFEVREEVPNNKEAAGREKGSRPVLTCYNED

SEQ ID NO: 859040 - protein, 562 aa, Homo sapiens; identical to SEQ ID NO: 859031

SEQ ID NO: 859041 - protein, 562 aa, Homo sapiens; identical to SEQ ID NO: 859031

SEQ ID NO: 859042 - protein, 623 aa, Homo sapiens; identical to SEQ ID NO: 859030

SEQ ID NO: 859043 - protein, 372 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKHGIKYGTLN

SEQ ID NO: 859044 - protein, 588 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGVRGARGGRGGNVGGKRKADGYNQPDSKRRQTNNQNWGSQPIAQQPLQGGDHSGNYGYKSENQEFYQDTFGQQWK

SEQ ID NO: 859045 - protein, 507 aa, Homo sapiens
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQNVFQQKSFITPSMVS

SEQ ID NO: 859046 - protein, 138 aa, Homo sapiens [sequence omitted]

SEQ ID NO: 859047 - protein, 134 aa, Homo sapiens
MLGPACAVGQRHGRLPWARLFQPSIQLARQGFPVGKGLAAALENKRTVIEQQPVLCEVFCRDRKVLREGERLTLPQLADTYETLAYSTCLASGLTNDSREHRNQILRMDDQNHQCTCSNQMFGARYYGYTKNIK

SEQ ID NO: 859048 - protein, 569 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDAVLYMPSAPLSGPVLALILNILKGYNFSRESVESPEQKGLTYHRIVEAFRFAYAKRTLLGDPKFVDVTEVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 859049 - protein, 569 aa, Homo sapiens; identical to SEQ ID NO: 859048

SEQ ID NO: 859050 - protein, 569 aa, Homo sapiens; identical to SEQ ID NO: 859048

SEQ ID NO: 859051 - protein, 576 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDAVLYMPSAPLSGPVLALILNILKGYNFSRESVESPEQKGLTYHRIVEAFRFAYAKRTLLGDPKFVDVTEASSGVWQVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 859052 - protein, 569 aa, Homo sapiens; identical to SEQ ID NO: 859048

SEQ ID NO: 859053 - protein, 229 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAYSTCRPAV

SEQ ID NO: 859054 - protein, 75 aa, Homo sapiens
MNTAHASQKEQKEKKKGGARKTERDESKRQSTRRGKRKRKPEEDKEKGDAEQQRRKDTRKTEKKKRDGRKKRKER

SEQ ID NO: 859055 - protein, 569 aa, Homo sapiens; identical to SEQ ID NO: 859048

SEQ ID NO: 859056 - protein, 569 aa, Homo sapiens; identical to SEQ ID NO: 859048

SEQ ID NO: 859057 - protein, 225 aa, Homo sapiens
MTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 859058 - protein, 238 aa, Homo sapiens
DRESDWSCKVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 859059 - protein, 184 aa, Homo sapiens
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 859060 - protein, 135 aa, Homo sapiens
MYGGGGGASPGGSGRGRTQRHASKAQAPRTRRTDRERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 859061 - protein, 184 aa, Homo sapiens; identical to SEQ ID NO: 859059

SEQ ID NO: 859062 - protein, 184 aa, Homo sapiens; identical to SEQ ID NO: 859059

SEQ ID NO: 859063 - protein, 235 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRWVYEAAVTLALVGFYIHSLVLAGDICTNLEGLSKDSLCFHTLPV

SEQ ID NO: 859064 - protein, 244 aa, Homo sapiens
MDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNTSTQSAHRPQEAPKARTGHQPPHSRR

SEQ ID NO: 859065 - protein, 134 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESMVVRACNPSYSE

SEQ ID NO: 859066 - protein, 856 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859067 - protein, 756 aa, Homo sapiens
MDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859068 - protein, 756 aa, Homo sapiens; identical to SEQ ID NO: 859067

SEQ ID NO: 859069 - protein, 856 aa, Homo sapiens; identical to SEQ ID NO: 859066

SEQ ID NO: 859070 - protein, 856 aa, Homo sapiens; identical to SEQ ID NO: 859066

SEQ ID NO: 859071 - protein, 707 aa, Homo sapiens
NYRLGTRLGVNRPRHRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859072 - protein, 856 aa, Homo sapiens; identical to SEQ ID NO: 859066

SEQ ID NO: 859073 - protein, 596 aa, Homo sapiens [sequence omitted]

SEQ ID NO: 859074 - protein, 761 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPELQPATLQPGRLQPGLHSPTASTSTTTCLQLWELRRLQPGPLYPTATPHRTDLPSAQL

SEQ ID NO: 859075 - protein, 757 aa, Homo sapiens
MDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKEANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859076 - protein, 815 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTHKEQTKEKNTEDSFNSL

SEQ ID NO: 859077 - protein, 736 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPRSPRCQTQKLFLQ

SEQ ID NO: 859078 - protein, 409 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859079 - protein, 323 aa, Homo sapiens
MDVRRLKVNELREELQRRGLDTRGLKAELAERLQAALEAEEPDDERELDADDEPGRPGHINEEVETEGGSELEGTAQPPPPGLHRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859080 - protein, 390 aa, Homo sapiens
MGFCHVGQAGLELLTSGDPPASASQSAGITGVSHRARPSVFVFLIHYSSFLHLLPSGRPLFWVEGTRLQKVLTSSSCSLWGTSFLLANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQSFGFFPSTFQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859081 - protein, 564 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKER

SEQ ID NO: 859082 - protein, 285 aa, Homo sapiens
VLLLVMWLVVLLLVVMVVVGSITVGGDGGGVVVLLFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQSFGFFPSTFQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859083 - protein, 251 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQTPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859084 - protein, 239 aa, Homo sapiens
LGSRYWRLSQGCCCSYCRCWPLWGSEQGCSWVVAVAAGVVAVVASSAMNRDNNNSNNRGSYNRAPQQQPPPQQPPPPQPPPQQPPPPPSYSPARNPPGASTYNKNSNIPGSSANTSTPTVSSYSPPQSFGFFPSTFQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859085 - protein, 66 aa, Homo sapiens
VLIQFELCIPSVDLIYILPSPSYNQYQQYAQQWNQYYQNQGQWPPYYGNYDYGSYSGNTQGGTSTQ

SEQ ID NO: 859086 - protein, 109 aa, Homo sapiens
THEHTAHKRTAPHTHAHTGASTYNKNSNIPGSSANTSTPTVSSYSPPQPSYSQPPYNQGGYSQGYTAPPPPPPPPPAYNYGSYGGYNPAPYTHKEQTKEKNTEDSFNSL

SEQ ID NO: 859087 - protein, 108 aa, Homo sapiens
GKKSTNSRFENYGDKFAENDVIGCFAVSASSLWELAEPDVGLQTSFSGYLYPLSAPYPATLAILLCLCLTDWNVYCHFVGNSVIPSPLVLCAKFSDDTLKRFGDFRCA

SEQ ID NO: 859088 - protein, 131 aa, Homo sapiens
RELAYVDTIAVVSLVTLVFVHHPPWLVCMLIVAAVLVVLRVCMFMSRVDCSVHVAPPSFCVPYDRCCTYATSFSVLGRVLSSLCKYCFINGVEKSGSKTNAGGQTFTPNKSPWGNTIHAEGKFCPHTLNLL

SEQ ID NO: 859089 - protein, 153 aa, Homo sapiens
GRGWRGGFRTVGIGDRKLLSGAEESRKNKRFSVWVGEGLENGDPRVRSSVGLAVVLAQRVGWGVGSRVSRVGKECPGVRGCESSEEGGSWNMPLDAILGVLLFGCHGQYYQAEPILRYPSHQTRKRVGLPGARPKSFSYSDTLYFYFPLTHMF

SEQ ID NO: 859090 - protein, 756 aa, Homo sapiens; identical to SEQ ID NO: 859067

SEQ ID NO: 859091 - protein, 756 aa, Homo sapiens; identical to SEQ ID NO: 859067

SEQ ID NO: 859092 - protein, 756 aa, Homo sapiens; identical to SEQ ID NO: 859067

SEQ ID NO: 859093 - protein, 866 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQSFGFFPSTFQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859094 - protein, 653 aa, Homo sapiens
NWLGTRPGFRDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859095 - protein, 595 aa, Homo sapiens
MGPPRGRGIITDQTADDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859096 - protein, 857 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKEANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859097 - protein, 810 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPP

SEQ ID NO: 859098 - protein, 748 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPQGSYKERHPGQAYRTHESKLKSCFP

SEQ ID NO: 859099 - protein, 380 aa, Homo sapiens
MGFCHVGQAGLELLTSGDPPASASQSAGITGVSHRARPSVFVFLIHYSSFLHLLPSGRPLFWVEGTRLQKVLTSSSCSLWGTSFLLANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859100 - protein, 165 aa, Homo sapiens
MDVRRLKVNELREELQRRGLDTRGLKAELAERLQAALEAEEPDDERELDADDEPGRPGHINEEPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859101 - protein, 191 aa, Homo sapiens
IRSRYRGWVAARDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859102 - protein, 192 aa, Homo sapiens
NYRLGTRLGVNRPRPGAAGVVVASSAMKTEDPLEATVAAPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859103 - protein, 164 aa, Homo sapiens
LGSRYWRLSQGCCCSYCRCWPLWGSEQGCSWVVAVAAGVVAVVASSAMKTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 859104 - protein, 575 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKGSPRCQTQKLFLQ

SEQ ID NO: 859105 - protein, 143 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESVSQVPDPKAFPTVIPFIFTSP

SEQ ID NO: 859106 - protein, 111 aa, Homo sapiens
PLSRKKGGGGVLGFSPPFPNHFLYKATLLAFYFIFLRVLHRAQSGRGWGTKPSPQHWERPGHSCCSRSPQAVSKRQHWPLASVLPCPTPRTGYGLLGPRLLLLGLLEGQCL

SEQ ID NO: 859107 - protein, 111 aa, Homo sapiens [sequence omitted]

SEQ ID NO: 859108 - protein, 126 aa, Homo sapiens
PKFEGCGRFVTPLADPTPHWPGQLVLSRRLGPGSPSVRVGPWTPVQRRGNRTIQKRNLRLRKRVRDPSSPCGHGTDRVDHRLRDRAKTPEAGHLGSCRAPPHESSLCLCQSFSSFFAAVSFPVNHG

SEQ ID NO: 859109 - protein, 301 aa, Homo sapiens
MELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 859110 - protein, 301 aa, Homo sapiens; identical to SEQ ID NO: 859109

SEQ ID NO: 859111 - protein, 301 aa, Homo sapiens; identical to SEQ ID NO: 859109

SEQ ID NO: 859112 - protein, 321 aa, Homo sapiens
MISRHLQNNLMSVDPASSQAMELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 859113 - protein, 301 aa, Homo sapiens; identical to SEQ ID NO: 859109

SEQ ID NO: 859114 - protein, 312 aa, Homo sapiens
MDSVDPASSQAMELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 859115 - protein, 312 aa, Homo sapiens; identical to SEQ ID NO: 859114

SEQ ID NO: 859116 - protein, 386 aa, Homo sapiens
GEAGRDRTLNRIADCQPFSRPLRKDESRGRPGEVKTFSLVFSDNSLSNYWGIILDTSVPREIHTILVYQESNRKMDSVDPASSQAMELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 859117 - protein, 301 aa, Homo sapiens; identical to SEQ ID NO: 859109

SEQ ID NO: 859118 - protein, 301 aa, Homo sapiens; identical to SEQ ID NO: 859109

SEQ ID NO: 859119 - protein, 118 aa, Homo sapiens
MISRHLQNNLMSVDPASSQAMELSDVTLIEGVGNEVMVVAGVVVLILALVLAWLSTYVADSGSNQLLGAIVSAGDTSVLHLGHVDHLVAGQGNPEPTELPHPSEEDKQVQAAAVQRPP

SEQ ID NO: 859120 - protein, 183 aa, Homo sapiens
GEAGRDRTLNRIADCQPFSRPLRKDESRGRPGEVKTFSLVFSDNSLSNYWGIILDTSVPREIHTILVYQESNRKMDSVDPASSQAMELSDVTLIEGVGNEVMVVAGVVVLILALVLAWLSTYVADSGSNQLLGAIVSAGDTSVLHLGHVDHLVAGQGNPEPTELPHPSEEDKQVQAAAVQRPP

SEQ ID NO: 859121 - protein, 111 aa, Homo sapiens [sequence omitted]

SEQ ID NO: 859122 - protein, 111 aa, Homo sapiens [sequence omitted]

SEQ ID NO: 859123 - protein, 126 aa, Homo sapiens; identical to SEQ ID NO: 859108

SEQ ID NO: 859124 - protein, 301 aa, Homo sapiens; identical to SEQ ID NO: 859109

SEQ ID NO: 859125 - protein, 317 aa, Homo sapiens
MELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKRVSGLGSGKLLVLIPQPLVASKEAGADMGAAAKCKIQPLPRAGRYFLRNTPFRPGAVAPGTLGGRGGCITRLGVRDQPDQHGETPSLLNIQKSAGRGGARLQSQLLRRLRQENRLNPGGGGCSEPRLRHCTPAWATE

SEQ ID NO: 859126 - protein, 111 aa, Homo sapiens
MELSDVTLIEGVGNEVMVVAGVVVLILALVLAWLSTYVADSGSNQLLGAIVSAGDTSVLHLGHVDHLVAGQGNPEPTELPHPSEGSSEGVQSCWPSSVGSLGSEIPSHLWF

SEQ ID NO: 859127 - protein, 126 aa, Homo sapiens; identical to SEQ ID NO: 859108

SEQ ID NO: 859128 - protein, 111 aa, Homo sapiens [sequence omitted]

SEQ ID NO: 859129 - protein, 111 aa, Homo sapiens [sequence omitted]

SEQ ID NO: 859130 - protein, 111 aa, Homo sapiens [sequence omitted]

SEQ ID NO: 859131 - protein, 111 aa, Homo sapiens [sequence omitted]

SEQ ID NO: 859132 - protein, 321 aa, Homo sapiens; identical to SEQ ID NO: 859112

SEQ ID NO: 859133 - protein, 321 aa, Homo sapiens; identical to SEQ ID NO: 859112

SEQ ID NO: 859134 - protein, 312 aa, Homo sapiens; identical to SEQ ID NO: 859114

SEQ ID NO: 859135 - protein, 301 aa, Homo sapiens; identical to SEQ ID NO: 859109

SEQ ID NO: 859136 - protein, 409 aa, Homo sapiens
MSTCSPVPCGRTAREQHYYYWAAFSKWGIRSGVIVSKLMYNRLINPVAVSYMCPSHSLPEGIYDVFRIGVITVNTLIKQITYIVVCEIRLAILAQGRMEGRLCMILPYCMRVEMVLMTADRLVGKVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 859137 - protein, 111 aa, Homo sapiens [sequence omitted]

SEQ ID NO: 859138 - protein, 111 aa, Homo sapiens [sequence omitted]

SEQ ID NO: 859139 - protein, 126 aa, Homo sapiens; identical to SEQ ID NO: 859108

SEQ ID NO: 859140 - protein, 143 aa, Homo sapiens
WSRPVCLLIPHPLSFLPCLSSLHKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 859141 - protein, 301 aa, Homo sapiens; identical to SEQ ID NO: 859109

SEQ ID NO: 859142 - protein, 255 aa, Homo sapiens
MELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAGSSEGVQSCWPSSVGSLGSEIPSHLWF

SEQ ID NO: 859143 - protein, 302 aa, Homo sapiens
MELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAEQQSRGPPEIWDSTCLPPSPGLITVRLKFLNDTEELAVARPEDTVGALKSKYSPGQESQMKLIYQGSICSARHP

SEQ ID NO: 859144 - protein, 126 aa, Homo sapiens; identical to SEQ ID NO: 859108

SEQ ID NO: 859145 - protein, 335 aa, Homo sapiens
MAEGGSPDGRAGPGSAGRNLKEWLREQFCDHPLEHCEDTRLHDAAYVGDLQTLRSLLQEESYRSRINEKSVWCCGWLPCTPLRIAATAGHGSCVDFLIRKGAEVDLVDVKGQTALYVAVVNGHLESTQILLEAGADPNGSRHHRSTPVYHASRVGRADILKALIRYGADVDVNHHLTPDVQPRFSRRLTSLVVCPLYISAAYHNLQCFRLLLLAGANPDFNCNGPVNTQGFYRGSPGCVMDAVLRHGCEAAFVSLLVEFGANLNLVKWESLGPESRGRRKVDPEALQVFKEARSVPRTLLCLCRVAVRRALGKHRLHLIPSLPLPDPIKKFLLHE

SEQ ID NO: 859146 - protein, 335 aa, Homo sapiens; identical to SEQ ID NO: 859145

SEQ ID NO: 859147 - protein, 912 aa, Homo sapiens
MKGTKRRKIRRKRKEKRKKKRKRRKKGPSKATVKAMQEALAKLKEEEERQKREEEERIKRLEELEAKRKEEERLEQEKRERKKQKEKERKERLKKEGKLLTKSQREARARAEATLKLLQAQGVEVPSKDSLPKKRPIYEDKKRKKIPQQLESKEVSESMELCAAVEVMEQGVPEKEETPPPVEPEEEEDTEDAGLDDWEAMASDEETEKVEGNTVHIEVKENPEEEEEEEEEEEEDEESEEEEEEEGESEGSEGDEEDEKVSDEKDSGKTLDKKPSKEMSSDSEYDSDDDRTKEERAYDKAKRRIEKRRLEHSKNVNTEKLRAPIICVLGHVDTGKTKILDKLRHTHVQDGEAGGITQQIGATNVPLEAINEQTKMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPGESPKMFGRHFEATDILVSKISRQSIDALKDWFRDEMQKSDWQLIVELKKVFEII

SEQ ID NO: 859148 - protein, 101 aa, Homo sapiens
SRALRPHAEAAGRCACALRTDTICVLFQCAGLWRAGCERRQHEGKRAERRPKSAGRQWVCERPNRGAGATSAIDKQWGRNRKTRAKTAPRMTLILMPWLQK

SEQ ID NO: 859149 - protein, 97 aa, Homo sapiens
VEPEEEEDTEDAGLDDWEAMASDEEKKKRKRRKKGPSKATVKAMQEALAKLKEEEERQKREEEERIKRLEELEAKRKEEERVYKKKEKVKRDSDEEM

SEQ ID NO: 859150 - protein, 912 aa, Homo sapiens; identical to SEQ ID NO: 859147

SEQ ID NO: 859151 - protein, 912 aa, Homo sapiens; identical to SEQ ID NO: 859147

SEQ ID NO: 859152 - protein, 912 aa, Homo sapiens; identical to SEQ ID NO: 859147

SEQ ID NO: 859153 - protein, 892 aa, Homo sapiens
MKGTKRRKIRRKRKEKRKKKRKRRKKGPSKATVKAMQEALAKLKEEEERQKREEEERIKRLEELEAKRKEEERLEQEKRERKKQKEKERKERLKKEGKLLTKSQREARARAEATLKLLQAQGVEVPSKDSLPKKRPIYEDKKRKKIPQQLESKEVSESMELCAAVEVMEQGVPEKEETPPPVEPEEEEDTEDAGLDDWEAMASDEETEKVEGNTVHIEVKENPEEEEEEEEEEEEDEESEEEEEEEGESEGSEGDEEDEKVSDEKDSGKTLDKKPSKEMSSDSEYDSDDDRTKEERAYDKAKRRIEKRRLEHSKNVNTEKLRAPIICVLGHVDTGKTKILDKLRHTHVQDGEAGGITQQIGATNVPLEAINEQTKMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPISRQSIDALKDWFRDEMQKSDWQLIVELKKVFEII

SEQ ID NO: 859154 - protein, 774 aa, Homo sapiens
MKGTKRRKIRRKRKEKRKKKRKRRKKGPSKATVKAMQEALAKLKEEEERQKREEEERIKRLEELEAKRKEEERLEQEKRERKKQKEKERKERLKKEGKLLTKSQREARARAEATLKLLQAQGVEVPSKDSLPKKRPIYEDKKRKKIPQQLESKEVSESMELCAAVEVMEQGVPEKEETPPPVEPEEEEDTEDAGLDDWEAMASDEETEKVEGNTVHIEVKENPEEEEEEEEEEEEDEESEEEEEEEGESEGSEGDEEDEKVSDEKDSGKTLDKKPSKEMSSDSEYDSDDDRTKEERAYDKAKRRIEKRRLEHSKNVNTEKLRAPIICVLGHVDTGKTKILDKLRHTHVQDGEAGGITQQIGATNVPLEAINEQTKMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKLEELEAKRKEEERLEQEKRERKKQKEKERKERLKKEGKLLTKSQREARARAEATLKLLQAQGVEVPSKDSPKKRPIYEAKKKKDKKKKKGEKEEKEKEKKKGPSKATVKAMQEALAKLKEEEERQKREEEERIKRLEELEAKRKEEERLEQEKRERKKQKK

SEQ ID NO: 859155 - protein, 309 aa, Homo sapiens
MGKKQKNKSEDSTKDDIDLDALAAEIEGAGAAKEQEPQKSKGKKKKEKKKQDFDEDDILKELEELSLEAQGIKADRETVAVKPTENNEEEFTSKDKKKKGQKGKKQSFDDNDSEELEDKDSKSKKTAKPKVEMYSGSDDDDDFNKLPKKAKGKAQKSNKKWDGSEEDEDNSKKIKERSRINSSGESGDESDEFLQSRKGQKKNQKNKPGPNIESGNEDDDASFKIKTVAQKKAEKKERERKKRDEEKAKLRKLKEKEELETGKKDQSKQKESQRKFEEETVKSKVTVDTGVIPASEEKAETPTAARRRQ

SEQ ID NO: 859156 - protein, 309 aa, Homo sapiens; identical to SEQ ID NO: 859155

SEQ ID NO: 859157 - protein, 912 aa, Homo sapiens; identical to SEQ ID NO: 859147

SEQ ID NO: 859158 - protein, 915 aa, Homo sapiens
MMTPPSKLRQWPKRRQKRRRKKKRKRRKKGPSKATVKAMQEALAKLKEEEERQKREEEERIKRLEELEAKRKEEERLEQEKRERKKQKEKERKERLKKEGKLLTKSQREARARAEATLKLLQAQGVEVPSKDSLPKKRPIYEDKKRKKIPQQLESKEVSESMELCAAVEVMEQGVPEKEETPPPVEPEEEEDTEDAGLDDWEAMASDEETEKVEGNTVHIEVKENPEEEEEEEEEEEEDEESEEEEEEEGESEGSEGDEEDEKVSDEKDSGKTLDKKPSKEMSSDSEYDSDDDRTKEERAYDKAKRRIEKRRLEHSKNVNTEKLRAPIICVLGHVDTGKTKILDKLRHTHVQDGEAGGITQQIGATNVPLEAINEQTKMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPGESPKMFGRHFEATDILVSKISRQSIDALKDWFRDEMQKSDWQLIVELKKVFEII

SEQ ID NO: 859159 - protein, 912 aa, Homo sapiens; identical to SEQ ID NO: 859147

SEQ ID NO: 859160 - protein, 754 aa, Homo sapiens [sequence omitted]

SEQ ID NO: 859161 - protein, 915 aa, Homo sapiens; identical to SEQ ID NO: 859158

SEQ ID NO: 859162 - protein, 309 aa, Homo sapiens; identical to SEQ ID NO: 859155

SEQ ID NO: 859163 - protein, 724 aa, Homo sapiens
TTRRGRVGRPTRSASDEETEKVEGNTVHIEVKENPEEEEEEEEEEEEDEESEEEEEEEGESEGSEGDEEDEKVSDEKDSGKTLDKKPSKEMSSDSEYDSDDDRTKEERAYDKAKRRIEKRRLEHSKNVNTEKLRAPIICVLGHVDTGKTKILDKLRHTHVQDGEAGGITQQIGATNVPLEAINEQTKMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPGESPKMFGRHFEATDILVSKISRQSIDALKDWFRDEMQKSDWQLIVELKKVFEII

SEQ ID NO: 859164 - protein, 514 aa, Homo sapiens
MNLSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPGESPKMFGRHFEATDILVSKISRQSIDALKDWFRDEMQKSDWQLIVELKKVFEII

SEQ ID NO: 859165 - protein, 143 aa, Homo sapiens
SFSLLTFEATLKLLQAQGVEVPSKDSLPKKRPIYEDKKRKKIPQQLESKEVSESMELCAAVEVMEQGVPEKEETPPPVEPEEEEDTEDAGLDDWEAMASDEETEKEEEDSTKDDIDLDALAAEIEGAGAAKEQEPQKSKGKKR

SEQ ID NO: 859166 - protein, 44 aa, Homo sapiens
KKQKEKERKERLKKEGKLLTKSQREARARAEATLKLLQAQGEWY

SEQ ID NO: 859167 - protein, 212 aa, Homo sapiens
MGKKQKNKSEDSTKDDIDLDALAAEIEGAGAAKEQEPQKSKGKKKKEKKKQDFDEDDILKELEELSLEAQGIKADRETVAVKPTENNEEEFTSKDKKKKGQKGKKQSFDDNDSEELEDKDSKSKKTAKPKVEMYSGSDDDDDFNKLPKKAKGKAQKSNKKWDGSEEDEDNSKKIKERSRINSSGESGDESDEFLQSRKGQKIGKRRLIRDEI

SEQ ID NO: 859168 - protein, 68 aa, Homo sapiens
NRQPSSHDWEDSFLQVSMALDSQLTENKDSQPGDSGSVRDRIEGLGPRAPLTSNGEETEKQERRQHQG

SEQ ID NO: 859169 - protein, 62 aa, Homo sapiens
IYRKSYSPLPTLGSLEALLEFLKTSEVPYAGINIGPVHKKDVMKASVMLEHDPQYAVISGLA

SEQ ID NO: 859170 - protein, 309 aa, Homo sapiens; identical to SEQ ID NO: 859155

SEQ ID NO: 859171 - protein, 309 aa, Homo sapiens; identical to SEQ ID NO: 859155

SEQ ID NO: 859172 - protein, 927 aa, Homo sapiens
YYYYTGARRRQKGTTMKGTKRRKIRRKRKEKRKKKRKRRKKGPSKATVKAMQEALAKLKEEEERQKREEEERIKRLEELEAKRKEEERLEQEKRERKKQKEKERKERLKKEGKLLTKSQREARARAEATLKLLQAQGVEVPSKDSLPKKRPIYEDKKRKKIPQQLESKEVSESMELCAAVEVMEQGVPEKEETPPPVEPEEEEDTEDAGLDDWEAMASDEETEKVEGNTVHIEVKENPEEEEEEEEEEEEDEESEEEEEEEGESEGSEGDEEDEKVSDEKDSGKTLDKKPSKEMSSDSEYDSDDDRTKEERAYDKAKRRIEKRRLEHSKNVNTEKLRAPIICVLGHVDTGKTKILDKLRHTHVQDGEAGGITQQIGATNVPLEAINEQTKMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPGESPKMFGRHFEATDILVSKISRQSIDALKDWFRDEMQKSDWQLIVELKKVFEII

SEQ ID NO: 859173 - protein, 912 aa, Homo sapiens; identical to SEQ ID NO: 859147

SEQ ID NO: 859174 - protein, 309 aa, Homo sapiens; identical to SEQ ID NO: 859155

SEQ ID NO: 859175 - protein, 309 aa, Homo sapiens; identical to SEQ ID NO: 859155

SEQ ID NO: 859176 - protein, 544 aa, Homo sapiens
QAVIQTQMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPGESPKMFGRHFEATDILVSKISRQSIDALKDWFRDEMQKSDWQLIVELKKVFEII

SEQ ID NO: 859177 - protein, 173 aa, Homo sapiens
MGKKQKNKSEDSTKDDIDLDALAAEIEGAGAAKEQEPQKSKGKKKKEKKKQDFDEDDILKELEELSLEAQGIKADRETVAVKPTENNEEEFTSKDKKKKGQKGKKQSFDDILKELEELSLEAQGIKADRETVAVKPTENNEEEFTSKDKKKKGQKELVLPKNRSLKSQKGKKK

SEQ ID NO: 859178 - protein, 150 aa, Homo sapiens
MADSGLLLKWGSCRSTWLRVRKARPQLILSRRPRRRLGSLRWCGRRRLRRRLLQAQAAGVDWREGARQVSRAAAARRPNTATPSPIPSPTPASEPESEPELESASSCHRPLLIPPVRPVGPGRALLLLPVEQMTGVGRCRIFLLSVPLCC

SEQ ID NO: 859179 - protein, 702 aa, Homo sapiens [sequence omitted]

SEQ ID NO: 859180 - protein, 702 aa, Homo sapiens [sequence omitted]

SEQ ID NO: 859181 - protein, 702 aa, Homo sapiens [sequence omitted]

SEQ ID NO: 859182 - protein, 415 aa, Homo sapiens
MFVSHSEEVDGCPVILVCGSQDVGKSTFNRYLINHLLNSLPCVDYLECDLGQTEFTPPGCISLLNITEPVLGPPFTHLRTPQKMVYYGKPSCKNNYENYIDIVKYVFSAYKRESPLIVNTMGWVSDQGLLLLIDLIRLLSPSHVVQFRSDHSKYMPDLTPQYVDDMDGLYTKSKTKMRNRRFRLAAFADALEFADEEKESPVEFTGHKLIGVYTDFAFRITPRNRESHNKILRDLSILSYLSQLQPPMPKPLSPLHSLTPYQVPFNAVALRITHSDVAPTHILYAVNASWVGLCKIQDDVRGYTNGPILLAQTPICDCLGFGICRGIDMEKRLYHILTPVPPEELRTVNCLLVGAIAIPHCVLKCQRGIEGTVPYVTTDYNFKLPGASEKIGAREPEEAHKEKPYRRPKFCRKMK

SEQ ID NO: 859183 - protein, 512 aa, Homo sapiens
MADSGLLLKWGSCRSTWLRVRKARPQLILSRRPRRRLGSLRWCGRRRLRRRLLQAQAAGVDWREGARQVSRAAAARRPNTATPSPIPSPTPASEPESEPELESASSCHRPLLIPPVRPVGPGRALLLLPVEQGFTFSGICRVTCLYGQVQVFGFTISQGQPAQDIFSVYTHSCLSIHALHYSQPEKSKKELKREARNLLKSHLNLDDRRWSMQNFSPQCSIVLLEHLKTATVNFITSYPGSSYIFVQESPTPQIKPEYLALRSVGIRREKKRKGLQLTESTLSALEELVNVSCEEVDGCPVILVCGSQDVGKSTFNRYLINHLLNSLPCVDYLECDLGQTEFTPPGCISLLNITEPVLGPPFTHLRTPQKMVYYGKPSCKNNYENYIDIVKYVFSAYKRESPLIVNTMGWVSDQGLLLLIDLIRLLSPSHVVQFRSDHSKYMPDLTPQYVDDMDGLYTKSKTKMRNRRFRLAAFADALEFADEEKESPVEFTGHKLIGVYTDFAFRITPRNR

SEQ ID NO: 859184 - protein, 531 aa, Homo sapiens
MEPRAVAEAVETGEEDVIMEALRSYNQEHSQSFTFDDAQQEDRKRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 859185 - protein, 421 aa, Homo sapiens
MDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 859186 - protein, 537 aa, Homo sapiens
MEPRAVAEAVETGEEDVIMEALRSYNQEHSQSFTFDDAQQEDRKRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQGWPPPQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 859187 - protein, 481 aa, Homo sapiens
GGTTKLRLGTRLRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 859188 - protein, 557 aa, Homo sapiens
MEPRAVAEAVETGEEDVIMEALRSYNQEHSQSFTFDDAQQEDRKRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQVLPPLRDVRTRPEVGEMLRNKLVRLMTHLDTDVKRVAAEFLFVLCSESGELWRPRSQPTPPQPGLHTDLCLAPAVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 859189 - protein, 531 aa, Homo sapiens; identical to SEQ ID NO: 859184

SEQ ID NO: 859190 - protein, 225 aa, Homo sapiens [sequence omitted]

SEQ ID NO: 859191 - protein, 132 aa, Homo sapiens
MEPRAVAEAVETGEEDVIMEALRSYNQEHSQSFTFDDAQQEDRKRLAELLVSVLEQGLPPSHRVIWLQSVRILSRDRNCLDPFTSRQSLQALANRVIQPMGMSPRGHLTSLQDAMCETMEQQLSSDPDSDPD

SEQ ID NO: 859192 - protein, 118 aa, Homo sapiens
MPCARLWSSSSPRTLTRTLTEDGSSSAPPSGLVLLPETSLGLQPGEATSHWIHTRPHFSILETPSLDSRSVHDLPLVQFLISGLQRSSCARTQAQPRIPQTKYFLLSAPRGMCSEAAA

SEQ ID NO: 859193 - protein, 421 aa, Homo sapiens; identical to SEQ ID NO: 859185

SEQ ID NO: 859194 - protein, 421 aa, Homo sapiens; identical to SEQ ID NO: 859185

SEQ ID NO: 859195 - protein, 483 aa, Homo sapiens
RPALPPPTVCIVRSRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 859196 - protein, 610 aa, Homo sapiens
MEPRAVAEAVETGEEDVIMEALRSYNQEHSQSFTFDDAQQEDRKRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRMPCARLWSSSSPRTLTRTLTEDGSSSAPPSGLVLLPETSLGLQPGEATSHWIHTRPHFSILETPSLDSRSVHDLPLVQFLISGLQRSSCARTQAQPRIPQTKYFLLSAPRGMCSEAAA

SEQ ID NO: 859197 - protein, 531 aa, Homo sapiens; identical to SEQ ID NO: 859184

SEQ ID NO: 859198 - protein, 531 aa, Homo sapiens; identical to SEQ ID NO: 859184

SEQ ID NO: 859199 - protein, 531 aa, Homo sapiens; identical to SEQ ID NO: 859184

SEQ ID NO: 859200 - protein, 155 aa, Homo sapiens
MVRGLRLNSADVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 859201 - protein, 94 aa, Homo sapiens
RVTNAFPTFHPLGNSINPVTGRVEEKPPNPMEGMTEEQKEHEAMKLVTMFDKLSRNRVIQPMGMSPRGHLTSLQDAMCETMEQQLSSDPDSDPD

SEQ ID NO: 859202 - protein, 597 aa, Homo sapiens
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETPTTEVPAPFFLPASLSANNTPTRRVSPLNLSSVTP

SEQ ID NO: 859203 - protein, 151 aa, Homo sapiens
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLVRAILKCHSAFSETSIFRTNGKVKSFK

SEQ ID NO: 859204 - protein, 234 aa, Homo sapiens
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMVNCDELCEKPSASSLL

SEQ ID NO: 859205 - protein, 571 aa, Homo sapiens
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETLYPELAVGH

SEQ ID NO: 859206 - protein, 151 aa, Homo sapiens; identical to SEQ ID NO: 859203

SEQ ID NO: 859207 - protein, 409 aa, Homo sapiens
MDLDFISTHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETPTTEVPAPFFLPASLSANNTPTRRVSPLNLSSVTP

SEQ ID NO: 859208 - protein, 151 aa, Homo sapiens; identical to SEQ ID NO: 859203

SEQ ID NO: 859209 - protein, 681 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWATDPDMYLQSPQSERTDPHGLYLSCNGGTPAGHKQMPWPEPQSPRVLPNGLAAKAQSLGPAEFQGASQRCLQLGACLQSSPPGASPPTGTNRHGMKAAKHGSEEARPQSCLVGSATGRPGGEGSPSPKTRESSLKRRLFRSMFLSTAATAPPSSSKPGPPPQSKPNSSFRPPQKDNPPSLVAKAQSLPSDQPVGTFSPLTTSDTSSPQKSLRTAPATGQLPGRSSPAGSPRTWHAQISTSNLYLPQDPTVAKGALAGEDTGVVTHEQFKAALRMVVDQGDPRLLLDSYVKIGEGSTGIVCLAREKHSGRQVAVKMMDLRKQQRRELLFNEVVIMRDYQHFNVVEMYKSYLVGEELWVLMEFLQGGALTDIVSQVRLNEEQIATVCEAVLQALAYLHAQGVIHRDIKSDSILLTLDGRVKLSDFGFCAQISKDVPKRKSLVGTPYWMAPEVISRSLYATEVDIWSLGIMVIEMVDGEPPYFSDSPVQAMKRLRDSPPPKLKNSHKVSPVLRDFLERMLVRDPQERATAQELLDHPFLLQTGLPECLVPLIQLYRKQTSTC

SEQ ID NO: 859210 - protein, 681 aa, Homo sapiens; identical to SEQ ID NO: 859209

SEQ ID NO: 859211 - protein, 681 aa, Homo sapiens; identical to SEQ ID NO: 859209

SEQ ID NO: 859212 - protein, 258 aa, Homo sapiens
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNARRKSNCVKEVEKLQEKREKRRLQQQELREKRAQQKKNLCGAALRTPRKRFLKNTRVGAAGAPHEVKAHPGHRAAPREKTRARHQGGVSPHKKRPARTRSVLEHTKGFRGTHGSHSGVQQGDDKY

SEQ ID NO: 859213 - protein, 706 aa, Homo sapiens
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPSRRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 859214 - protein, 706 aa, Homo sapiens; identical to SEQ ID NO: 859213

SEQ ID NO: 859215 - protein, 687 aa, Homo sapiens
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNARRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 859216 - protein, 684 aa, Homo sapiens
TRGSTHAIRIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNARRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 859217 - protein, 369 aa, Homo sapiens
MKFLTARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 859218 - protein, 706 aa, Homo sapiens; identical to SEQ ID NO: 859213

SEQ ID NO: 859219 - protein, 154 aa, Homo sapiens
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPCM

SEQ ID NO: 859220 - protein, 745 aa, Homo sapiens
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPSRRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKEFGISPSDIPFSQGSGSRPDLSPSYEYDDFSPSVTKVVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 859221 - protein, 690 aa, Homo sapiens
MHTTSGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPSRRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 859222 - protein, 706 aa, Homo sapiens; identical to SEQ ID NO: 859213

SEQ ID NO: 859223 - protein, 706 aa, Homo sapiens; identical to SEQ ID NO: 859213

SEQ ID NO: 859224 - protein, 953 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 859225 - protein, 138 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPKVPRPCFCFLKVL

SEQ ID NO: 859226 - protein, 953 aa, Homo sapiens; identical to SEQ ID NO: 859224

SEQ ID NO: 859227 - protein, 953 aa, Homo sapiens; identical to SEQ ID NO: 859224

SEQ ID NO: 859228 - protein, 953 aa, Homo sapiens; identical to SEQ ID NO: 859224

SEQ ID NO: 859229 - protein, 849 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKR

SEQ ID NO: 859230 - protein, 959 aa, Homo sapiens [sequence omitted]

SEQ ID NO: 859231 - protein, 911 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIGNYRLSAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 859232 - protein, 970 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGSECHNLLAVQDWAYWMRGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 859233 - protein, 857 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKQNKKAYIKDIAHKDVAERHAEALGKAEQLN

SEQ ID NO: 859234 - protein, 366 aa, Homo sapiens
MAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 859235 - protein, 830 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKVSTAVLSITAKAKKKEKEKEKKEEEKMEVVGINW

SEQ ID NO: 859236 - protein, 413 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLSFGSGFLFHTSCHWLIPLPVSLALTRT

SEQ ID NO: 859237 - protein, 763 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKLSIGGIIILKDTSEDIEELVEPVAAHGPKIEEEEQEPEPPEPFEYIDD

SEQ ID NO: 859238 - protein, 699 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKVKPTANGVSSFLAPDCFPSPQNLCNSCKNTSAM

SEQ ID NO: 859239 - protein, 229 aa, Homo sapiens
MAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 859240 - protein, 141 aa, Homo sapiens
MSVRDYNSLPCSFPQVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 859241 - protein, 173 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNSK

SEQ ID NO: 859242 - protein, 953 aa, Homo sapiens; identical to SEQ ID NO: 859224

SEQ ID NO: 859243 - protein, 953 aa, Homo sapiens; identical to SEQ ID NO: 859224

SEQ ID NO: 859244 - protein, 953 aa, Homo sapiens; identical to SEQ ID NO: 859224

SEQ ID NO: 859245 - protein, 955 aa, Homo sapiens
MTHRGRVELIFVFWMNDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 859246 - protein, 633 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRKPLIC

SEQ ID NO: 859247 - protein, 828 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKR

SEQ ID NO: 859248 - protein, 452 aa, Homo sapiens
HFTRYLPGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 859249 - protein, 411 aa, Homo sapiens
MASSRFCLEAYKLLIRLFVLSLSGLGTPLCGKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 859250 - protein, 749 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAVLDCKEIVTL

SEQ ID NO: 859251 - protein, 740 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAG

SEQ ID NO: 859252 - protein, 633 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFSEEKRI

SEQ ID NO: 859253 - protein, 105 aa, Homo sapiens
IHHRVTRRRVAAADSTQNPEGPRRRFSPVRERDGVPLCHAGCQAGVQWRNLSSLQPPPPGFKRFSCLCLLSSWDYWHTPPCTGRYETSINICKMYISFVWKDGTT

SEQ ID NO: 859254 - protein, 132 aa, Homo sapiens
MFYTTGQTAALLYIWSTFWASPVAPFKCMVLKRSKFMSLRSAPPFLHYIINSSLFFFFGDGVPLCHAGCQAGVQWRNLSSLQPPPPGFKRFSCLCLLSSWDYWHTPPCTGRYETSINICKMYISFVWKDGTT

SEQ ID NO: 859255 - protein, 132 aa, Homo sapiens; identical to SEQ ID NO: 859254

SEQ ID NO: 859256 - protein, 132 aa, Homo sapiens; identical to SEQ ID NO: 859254

SEQ ID NO: 859257 - protein, 105 aa, Homo sapiens; identical to SEQ ID NO: 859253

SEQ ID NO: 859258 - protein, 105 aa, Homo sapiens; identical to SEQ ID NO: 859253

SEQ ID NO: 859259 - protein, 115 aa, Homo sapiens
AGITGVSHHTRPNKWNFSWTSSLLVMWEELGLCSKSAGIFLITQDFTCELDQPLLLSLSRSGHVWQPGLHNEDFHNLVFIYLFSFCPNDEGGSLHLAPWGQAETVCALPSYRDQI

SEQ ID NO: 859260 - protein, 105 aa, Homo sapiens; identical to SEQ ID NO: 859253

SEQ ID NO: 859261 - protein, 105 aa, Homo sapiens; identical to SEQ ID NO: 859253

SEQ ID NO: 859262 - protein, 132 aa, Homo sapiens; identical to SEQ ID NO: 859254

SEQ ID NO: 859263 - protein, 132 aa, Homo sapiens; identical to SEQ ID NO: 859254

SEQ ID NO: 859264 - protein, 132 aa, Homo sapiens; identical to SEQ ID NO: 859254

SEQ ID NO: 859265 - protein, 104 aa, Homo sapiens
MSSCWSRVDSEPSGTSVLIKKREIWTHTEQRPPCEDGGRDRRDAATRHKCLGLPETTRSLPQRLQQEHGSANTLILVFQPPERFPKIPFSTGVWCKMRHIFHGW

SEQ ID NO: 859266 - protein, 333 aa, Homo sapiens
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 859267 - protein, 299 aa, Homo sapiens
MSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 859268 - protein, 299 aa, Homo sapiens; identical to SEQ ID NO: 859267

SEQ ID NO: 859269 - protein, 333 aa, Homo sapiens; identical to SEQ ID NO: 859266

SEQ ID NO: 859270 - protein, 199 aa, Homo sapiens [sequence omitted]

SEQ ID NO: 859271 - protein, 333 aa, Homo sapiens; identical to SEQ ID NO: 859266

SEQ ID NO: 859272 - protein, 333 aa, Homo sapiens; identical to SEQ ID NO: 859266

SEQ ID NO: 859273 - protein, 333 aa, Homo sapiens; identical to SEQ ID NO: 859266

SEQ ID NO: 859274 - protein, 299 aa, Homo sapiens; identical to SEQ ID NO: 859267

SEQ ID NO: 859275 - protein, 333 aa, Homo sapiens; identical to SEQ ID NO: 859266

SEQ ID NO: 859276 - protein, 199 aa, Homo sapiens [sequence omitted]

SEQ ID NO: 859277 - protein, 333 aa, Homo sapiens; identical to SEQ ID NO: 859266

SEQ ID NO: 859278 - protein, 235 aa, Homo sapiens
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGRSLIRG

SEQ ID NO: 859279 - protein, 201 aa, Homo sapiens [sequence omitted]

SEQ ID NO: 859280 - protein, 106 aa, Homo sapiens
MSPFSATREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 859281 - protein, 212 aa, Homo sapiens
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKK

SEQ ID NO: 859282 - protein, 473 aa, Homo sapiens
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 859283 - protein, 541 aa, Homo sapiens
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCVSDLMGAAQFDSSRGHNLETGWIMDVFSHLFLCCEDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 859284 - protein, 307 aa, Homo sapiens
LQALGSLTLSSQVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 859285 - protein, 251 aa, Homo sapiens
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKRLRILNH

SEQ ID NO: 859286 - protein, 506 aa, Homo sapiens
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 859287 - protein, 509 aa, Homo sapiens
LWLPVAQGEESLQVGGQQGQRCHRSGQCPEKPHLTFILLVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 859288 - protein, 582 aa, Homo sapiens
FRLLPEVPKLATKGTWEDPTSAFVTSEAFCSCPGKPASCRAMPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCVSDLMGAAQFDSSRGHNLETGWIMDVFSHLFLCCEDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 859289 - protein, 506 aa, Homo sapiens; identical to SEQ ID NO: 859286

SEQ ID NO: 859290 - protein, 1816 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSSGRVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 859291 - protein, 129 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVTTDGEDPGFSASALSFILSSQGAREARAPT

SEQ ID NO: 859292 - protein, 1816 aa, Homo sapiens; identical to SEQ ID NO: 859290

SEQ ID NO: 859293 - protein, 1211 aa, Homo sapiens
MNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSSGRVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 859294 - protein, 1092 aa, Homo sapiens
IQARLTTLTGNAITSDIQTATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSSGRVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 859295 - protein, 1392 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSSGRVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTREGKVKMHLHGILLL

SEQ ID NO: 859296 - protein, 657 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDVSIP

SEQ ID NO: 859297 - protein, 1692 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSSGRVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFERNTKPARRNSNSSFGWKLSSS

SEQ ID NO: 859298 - protein, 1492 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSSGRVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAK

SEQ ID NO: 859299 - protein, 1333 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSSGRVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRLNRIACRYPL

SEQ ID NO: 859300 - protein, 734 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTQLSSDLYNQAIPIRVDLEGGHYPM

SEQ ID NO: 859301 - protein, 277 aa, Homo sapiens [sequence omitted]

SEQ ID NO: 859302 - protein, 230 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERPSPQSTRGFPLNDSKSNAGFFHTLSGECVPCDCNGNSNECLDRLQDTVCTARRTQQETTVKS

SEQ ID NO: 859303 - protein, 166 aa, Homo sapiens
MDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEVQRTLTINAFQHQQCDGTPRRGC

SEQ ID NO: 859304 - protein, 515 aa, Homo sapiens
MLALWYVKKPFSFDRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 859305 - protein, 179 aa, Homo sapiens
METGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 859306 - protein, 1692 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSSGRVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYLPSGGSFHRVEQDLNESSGTGYFLFLIWILNLESKVSAMDNN

SEQ ID NO: 859307 - protein, 1145 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFRWCAHHLSPKVVPEKEVNRMLTPSEFLKEV

SEQ ID NO: 859308 - protein, 367 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDDLRLAALSIEEGKSGVLSVSSGAAAHRHVNEINATIYLLKTKLSERENQYALRKIQINNAENTMKSLLSDVEELVEKHWNKPRRRLELQEGV

SEQ ID NO: 859309 - protein, 374 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKHWNKPRRRLELQEGV

SEQ ID NO: 859310 - protein, 120 aa, Homo sapiens
MALSSAWRSVLPLWLLWSAACSRAASGDDNAFPFDIEGSSAVGRQDPPETSEPRVALGRLPPAAEVQCPCHCHPAGAPAPPRAVPHSSFSLSPPLSSPQCLESFTWARSVRKLEIKSFPL

SEQ ID NO: 859311 - protein, 658 aa, Homo sapiens
CSGSSCRASRNRSRSEAQPDPAMEQPRKAVVVTGFGPFGEHTVNASWIAVQELEKLGLGDSVDLHVYEIPVEYQTVQRLIPALWEKHSPQLVVHVGVSGMATTVTLEKCGHNKGYKGLDNCRFCPGSQCCVEDGPESIDSIIDMDAVCKRVTTLGLDVSVTISQDAGSLGSQKSKVKVVAGLVPSGGAGGYLCDFTYYTSLYQSHGRSAFVHVPPLGKPYNADQLGRALRAIIEEMLDLLEQSEGKITIATNTEGRSGLLRPHPAGDPTRGHPPSGVWPGKDKLFSLGIRLDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859312 - protein, 413 aa, Homo sapiens
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859313 - protein, 441 aa, Homo sapiens
WYWSQVVDAQDPKWGSRSQRANSCPPSSMASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859314 - protein, 402 aa, Homo sapiens
FPSPSASSTPSSTSKSSSGGTPAGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859315 - protein, 413 aa, Homo sapiens; identical to SEQ ID NO: 859312

SEQ ID NO: 859316 - protein, 381 aa, Homo sapiens
KARSALRLGTRLGVDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859317 - protein, 636 aa, Homo sapiens
CSGSSCRASRNRSRSEAQPDPAMEQPRKAVVVTGFGPFGEHTVNASWIAVQELEKLGLGDSVDLHVYEIPVEYQTVQRLIPALWEKHSPQLVVHVGVSGMATTVTLEKCGHNKGYKGLDNCRFCPGSQCCVEDGPESIDSIIDMDAVCKRVTTLGLDVSVTISQDAGRYLCDFTYYTSLYQSHGRSAFVHVPPLGKPYNADQLGRALRAIIEEMLDLLEQSEGKINYCTNTEGRSGLLRPHPAGDPTRGHPPSGVWPGKDKLFSLGIRLDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859318 - protein, 359 aa, Homo sapiens
PELVFTLGDCDVIQALDLSVPLMDVGETAMVTADSKYCYGPQGRNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859319 - protein, 357 aa, Homo sapiens
MTCKMSQLERNIETIINTFHQYSVKLGHPDTPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859320 - protein, 429 aa, Homo sapiens
GHGRRGAKRPNLVPEARRPRLGAGRGAQDPKWGSRSQRANSCPPSSMASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKLPLPSADDPRRALKAGEEACGAAEHGDRLVPENAGQPQPAAC

SEQ ID NO: 859321 - protein, 459 aa, Homo sapiens
GHGRRGAKRPNLVPEARRPRLGAGRGAQDPKWGSRSQRANSCPPSSMASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859322 - protein, 202 aa, Homo sapiens [sequence omitted]

SEQ ID NO: 859323 - protein, 258 aa, Homo sapiens
TGEVQLRVRYSYGGGTATGEVQLLQLKVKCLNNLAASQLKLDHYRAALRSCSLVLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859324 - protein, 390 aa, Homo sapiens
GHGRRGAKRPNLVPEARRPRLGAGRGAQDPKWGSRSQRANSCPPSSMASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSERGPSFLQTQFSPTLLTPLG

SEQ ID NO: 859325 - protein, 92 aa, Homo sapiens
PRVAHASPTRRALKLEPSNKTIHAELSKLVKKHAAQRSTETALYRKMLGNPSRLPAKCPGKGAWSIPWKWLFGATAVALGGVALSVVIAARN

SEQ ID NO: 859326 - protein, 335 aa, Homo sapiens
GHGRRGAKRPNLVPEARRPRLGAGRGAQDPKWGSRSQRANSCPPSSMASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKASLPRWARSPPGLASVSPQQAWGQPFPCLVPA

SEQ ID NO: 859327 - protein, 141 aa, Homo sapiens
GHGRRGAKRPNLVPEARRPRLGAGRGAQDPKWGSRSQRANSCPPSSMASCAEPSEPSAPLPAGVPPLEDFEVLDGVEDAEGEEEEEEEEEEEWDGGRGCAKLHYYCKTTVCWKLKVLMGLPSLRPPVTSKNSNRSKPHWLA

SEQ ID NO: 859328 - protein, 106 aa, Homo sapiens
TGEVQLRVRYSYGGGTATGEVQLLQLKVKCLNNLAASQLKLDHYRAALRSCSLVLEMLTGQERVALANRKRECGNAHYQRADFVLAANSYDLAIKAITSSAKVVPA

SEQ ID NO: 859329 - protein, 459 aa, Homo sapiens; identical to SEQ ID NO: 859321

SEQ ID NO: 859330 - protein, 413 aa, Homo sapiens; identical to SEQ ID NO: 859312

SEQ ID NO: 859331 - protein, 428 aa, Homo sapiens
SPGGAGRANSCPPSSMASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859332 - protein, 413 aa, Homo sapiens; identical to SEQ ID NO: 859312

SEQ ID NO: 859333 - protein, 664 aa, Homo sapiens
LQRQQLSRQSQQKQVRGTARSRHGAAEEGGGSDGIWPFWGTHRERQLDCSSEMGSHYIALAGLELPGSNDPSTSASQRSWDYRCEPPSPAIQELEKLGLGDSVDLHVYEIPVEYQTVQRLIPALWEKHSPQLVVHVGVSGMATTVTLEKCGHNKGYKGLDNCRFCPGSQCCVEDGPESIDSIIDMDAVCKRVTTLGLDVSVTISQDAGRVTVDQPSSTCPHWGSRTTRTSWAGHWEPSLRRCWTSWSSQRAKSTIATNTEGRSGLLRPHPAGDPTRGHPPSGVWPGKDKLFSLGIRLDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 859334 - protein, 459 aa, Homo sapiens; identical to SEQ ID NO: 859321

SEQ ID NO: 859335 - protein, 459 aa, Homo sapiens; identical to SEQ ID NO: 859321

SEQ ID NO: 859336 - protein, 459 aa, Homo sapiens; identical to SEQ ID NO: 859321

SEQ ID NO: 859337 - protein, 459 aa, Homo sapiens; identical to SEQ ID NO: 859321

SEQ ID NO: 859338 - protein, 419 aa, Homo sapiens
GHGRRGAKRPNLVPEARRPRLGAGRGAQDPKWGSRSQRANSCPPSSMASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAARLPAKCPGKGAWSIPWKWLFGATAVALGGVALSVVIAARN

SEQ ID NO: 859339 - protein, 390 aa, Homo sapiens; identical to SEQ ID NO: 859324

SEQ ID NO: 859340 - protein, 364 aa, Homo sapiens
GHGRRGAKRPNLVPEARRPRLGAGRGAQDPKWGSRSQRANSCPPSSMASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKGES

SEQ ID NO: 859341 - protein, 89 aa, Homo sapiens
RTPKEAIGQPKLEPSNKTIHAELSKLVKKHAAQRSTETALYRKMLGNPSRLPAKCPGKGAWSIPWKWLFGATAVALGGVALSVVIAARN

SEQ ID NO: 859342 - protein, 111 aa, Homo sapiens
GHGRRGAKRPNLVPEARRPRLGAGRGAQDPKWGSRSQRANSCPPSSMASCAEPSEPSAPLPAGVPPLEDFEVLDGVEDAEGEEEEEEEEEEERGPSFLQTQFSPTLLTPLG

SEQ ID NO: 859343 - protein, 911 aa, Homo sapiens
MAASQTSQTVASHVPFADLCSTLERIQKSKGRAEKIRHFREFLDSWRKFHDALHKNHKDVTDSFYPAMRLILPQLERERMAYGIKETMLAKLYIELLNLPRDGKDALKLLNYRTPTGTHGDAGDFAMIAYFVLKPRCLQKGSLTIQQVNDLLDSIASNNSAKRKDLIKKSLLQLITQSSALEQKWLIRMIIKDLKLGVSQQTIFSVFHNDAAELHNVTTDLEKVCRQLHDPSVGLSDISITLFSAFKPMLAAIADIEHIEKDMKHQSFYIETKLDGERMQMHKDGDVYKYFSRNGYNYTDQFGASPTEGSLTPFIHNAFKADIQICILDGEMMAYNPNTQTFMQKGTKFDIKRMVEDSDLQTCYCVFDVLMVNNKKLGHETLRKRYEILSSIFTPIPGRIEIVQKTQAHTKNEVIDALNEAIDKREEGIMVKQPLSIYKPDKRGEGWLKIKPEYVSGLMDELDILIVGGYWGKGSRGGMMSHFLCAVAEKPPPGEKPSVFHTLSRVGSGCTMKELYDLGLKLAKYWKPFHRKAPPSSILCGTEKPEVYIEPCNSVIVQIKAAEIVPSDMYKTGCTLRFPRIEKIRDDKEWHECMTLDDLEQLRGKASGKLASKHLYIGGDDEPQEKKRKAAPKMKKVIGIIEHLKAPNLTNVNKISNIFEDVEFCVMSGTDSQPKPDLENRIAEFGGYIVQNPGPDTYCVIAGSENIRVKNIILSNKHDVVKPAWLLECFKTKSFVPWQPRFMIHMCPSTKEHFAREYDCYGDSYFIDTDLNQLKEVFSGIKNSNEQTPEEMASLIADLEYRYSWDCSPLSMFRRHTVYLDSYAVINDLSTKNEGTRLAIKALELRFHGAKVVSCLAEGVSHVIIGEDHSRVADFKAFRRTFKRKFKILKESWVTDSIDKCELQEENQYLI

SEQ ID NO: 859344 - protein, 911 aa, Homo sapiens; identical to SEQ ID NO: 859343

SEQ ID NO: 859345 - protein, 911 aa, Homo sapiens; identical to SEQ ID NO: 859343

SEQ ID NO: 859346 - protein, 893 aa, Homo sapiens
MAASQTSQTVASHVPFADLCSTLERIQKSKGRAEKIRHFREFLDSWRKFHDALHKNHKDVTDSFYPAMRLILPQLERERMAYGIKETMLAKLYIELLNLPRDGKDALKLLNYRTPTGTHGDAGDFAMIAYFVLKPRCLQKGSLTIQQVNDLLDSIASNNSAKRKDLIKKSLLQLITQSSALEQKWLIRMIIKDLKLGVSQQTIFSVFHNDAAELHNVTTDLDTLFSAFKPMLAAIADIEHIEKDMKHQSFYIETKLDGERMQMHKDGDVYKYFSRNGYNYTDQFGASPTEGSLTPFIHNAFKADIQICILDGEMMAYNPNTQTFMQKGTKFDIKRMVEDSDLQTCYCVFDVLMVNNKKLGHETLRKRYEILSSIFTPIPGRIEIVQKTQAHTKNEVIDALNEAIDKREEGIMVKQPLSIYKPDKRGEGWLKIKPEYVSGLMDELDILIVGGYWGKGSRGGMMSHFLCAVAEKPPPGEKPSVFHTLSRVGSGCTMKELYDLGLKLAKYWKPFHRKAPPSSILCGTEKPEVYIEPCNSVIVQIKAAEIVPSDMYKTGCTLRFPRIEKIRDDKEWHECMTLDDLEQLRGKASGKLASKHLYIGGDDEPQEKKRKAAPKMKKVIGIIEHLKAPNLTNVNKISNIFEDVEFCVMSGTDSQPKPDLENRIAEFGGYIVQNPGPDTYCVIAGSENIRVKNIILSNKHDVVKPAWLLECFKTKSFVPWQPRFMIHMCPSTKEHFAREYDCYGDSYFIDTDLNQLKEVFSGIKNSNEQTPEEMASLIADLEYRYSWDCSPLSMFRRHTVYLDSYAVINDLSTKNEGTRLAIKALELRFHGAKVVSCLAEGVSHVIIGEDHSRVADFKAFRRTFKRKFKILKESWVTDSIDKCELQEENQYLI

SEQ ID NO: 859347 - protein, 185 aa, Homo sapiens
HASRTRGSDAWVDDFLGDCGRIPGGYCRVLYGPRFVVRQRDKYRYFACLMRARFEEHKNEKDMAKATQLLKEAEEEFWYRQHPQPYIFPDSPGGTSYERYDCYKVPEWCLDDWHPSEKAMYPDYFAKREQWKKLRRESWEREVKQLQEETPPGGPLTEALPPARKEGDLPPLWWYIVTRPRERPM

SEQ ID NO: 859348 - protein, 179 aa, Homo sapiens
MAFLASGPYLTHQQKVLRLYKRALRHLESWCVQRDKYRYFACLMRARFEEHKNEKDMAKATQLLKEAEEEFWYRQHPQPYIFPDSPGGTSYERYDCYKVPEWCLDDWHPSEKAMYPDYFAKREQWKKLRRESWEREVKQLQEETPPGGPLTEALPPARKEGDLPPLWWYIVTRPRERPM

SEQ ID NO: 859349 - protein, 179 aa, Homo sapiens; identical to SEQ ID NO: 859348

SEQ ID NO: 859350 - protein, 179 aa, Homo sapiens; identical to SEQ ID NO: 859348

SEQ ID NO: 859351 - protein, 179 aa, Homo sapiens; identical to SEQ ID NO: 859348

SEQ ID NO: 859352 - protein, 123 aa, Homo sapiens
MAKATQLLKEAEEEFWYRQHPQPYIFPDSPGGTSYERYDCYKVPEWCLDDWHPSEKAMYPDYFAKREQWKKLRRESWEREVKQLQEETPPGGPLTEALPPARKEGDLPPLWWYIVTRPRERPM

SEQ ID NO: 859353 - protein, 95 aa, Homo sapiens
RRQLRPSGWPRSVTRSRRAVSRLSARPGKVSAVMAFLASGPYLTHQQKVLRLYKRALRHLESWCVQRDKYRYFACLMRARFEILVPSASTAIHLP

SEQ ID NO: 859354 - protein, 201 aa, Homo sapiens
MAFLASGPYLTHQQKVLRLYKRALRHLESWCVQRDKYRYFACLMRARFEEHKNEKDMAKATQLLKEAEEEFWYRQHPQPYIFPDSPGGTSYERYDCYKVPEWCLDDWHPSEKAMYPDYFAKREQWKKLRRESWERELSQPARRKRCIVIPYTQALTPAASTWYINRPMKMPFSKPPSLAFLDRWCVVALVSKTHLHSGTPE

SEQ ID NO: 859355 - protein, 174 aa, Homo sapiens
RRQLRPSGWPRSVTRSRRAVSRLSARPGKVSAVMAFLASGPYLTHQQKVLRLYKRALRHLESWCVQRDKYRYFACLMRARFEEHKNEKDMAKATQLLKEAEEEFWYRQHPQPYIFPDSPGGTSYERYDCYKVKQLQEETPPGGPLTEALPPARKEGDLPPLWWYIVTRPRERPM

SEQ ID NO: 859356 - protein, 85 aa, Homo sapiens
MRARFEEHKNEKDMAKATQLLKEAEEEFWYRQHPQPYIFPDSPGGTSYERYDCYKVGENYDDCLLRNRLCFFSPTPQPQKSLALQ

SEQ ID NO: 859357 - protein, 179 aa, Homo sapiens; identical to SEQ ID NO: 859348

SEQ ID NO: 859358 - protein, 185 aa, Homo sapiens; identical to SEQ ID NO: 859347

SEQ ID NO: 859359 - protein, 179 aa, Homo sapiens; identical to SEQ ID NO: 859348

SEQ ID NO: 859360 - protein, 224 aa, Homo sapiens
RRQLRPSGWPRSVTRSRRAVSRLSARPGKVSAVMAFLASGPYLTHQQKVLRLYKRALRHLESWCVQRDKYRYFACLMRARFEEHKNEKDMAKATQLLKEAEEEFWYRQHPQPYIFPDSPGGTSYERYDCYKVPEWCLDDWHPSEKAMYPDYFAKREQWKKLRRESWEREVKQLQEETPPGGPLTEALPPARKEGDLPPLWWYIVTRPRERPMYSGSDHRDTLER

SEQ ID NO: 859361 - protein, 139 aa, Homo sapiens
YWWCSLLAMYPDYFAKREQWKKLLKEAEEEFWYRQHPQPYIFPDSPGGTSYERYDCYKVPEWCLDDWHPSEKAMYPDYFAKREQWKKLRRESWEREVKQLQEETPPGGPLTEALPPARKEGDLPPLWWYIVTRPRERPM

SEQ ID NO: 859362 - protein, 112 aa, Homo sapiens
MLRFWYRQHPQPYIFPDSPGGTSYERYDCYKVPEWCLDDWHPSEKAMYPDYFAKREQWKKLRRESWEREVKQLQEETPPGGPLTEALPPARKEGDLPPLWWYIVTRPRERPM

SEQ ID NO: 859363 - protein, 135 aa, Homo sapiens
RRQLRPSGWPRSVTRSRRAVSRLSARPGKVSAVMAFLASGPYLTHQQKVLRLYKRALRHLESWCVQRDKYRYFACLMRARFEKLRRESWEREVKQLQEETPPGGPLTEALPPARKEGDLPPLWWYIVTRPRERPM

SEQ ID NO: 859364 - protein, 89 aa, Homo sapiens
GLRALCEPLSAKAMELCLESLVFGSGWGQSPGKTNAFGTRTQAPSSLPACGYNDSTWQATAFREGDRGPCLKHSPTTRNPQQPLKRKGS

SEQ ID NO: 859365 - protein, 155 aa, Homo sapiens
MVAWEQLMFEKAQAPASRGFEFTHAHIMGMNKPFFKKTRSSQGSYLLWAGAKAGCFSPHASRPRACFCSPAWKVQGTWKGATPNALYQRPPDTNSVLCACCSLSLSPPWTEGVKLAAPTGRGPLTSGLIVLDTQSGLDASSSPTLHPKVRKPDNF

SEQ ID NO: 859366 - protein, 155 aa, Homo sapiens; identical to SEQ ID NO: 859365

SEQ ID NO: 859367 - protein, 185 aa, Homo sapiens
GRGNECELVSGRRRHRPRRRRLGSSLRHAGVFSSTGAMSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGSGKG

SEQ ID NO: 859368 - protein, 290 aa, Homo sapiens [sequence omitted]

SEQ ID NO: 859369 - protein, 290 aa, Homo sapiens [sequence omitted]

SEQ ID NO: 859370 - protein, 290 aa, Homo sapiens [sequence omitted]

SEQ ID NO: 859371 - protein, 290 aa, Homo sapiens [sequence omitted]

SEQ ID NO: 859372 - protein, 548 aa, Homo sapiens
MVVEGEEAGEARRGPALHLSLLPACPLAVPSAVSSLTDDLLKYYHQVTRAVLGDDPQLMKVALQDLQTNSKIGALLPYFVYVVSGVKSVSHDLEQLHRLLQVARSLFRNPHLCLGPYVRCLVGSVLYCVLEPLAASINPLNDHWTLRDGAALLLSHIFWTHGDLVSGLYQHILLSLQKILADPVRPLCCHYGAVVGLHALGWKAVERVLYPHLSTYWTNLQAVLDDYSVSNAQVKADGHKVYGAILSEYRPLPASLPCMSLAAKQAYFGIFDGPRFLEFFAYLSPWLLQVAVERLLKMKAQAAEPNRGGPGGRGCRRLDDLPWDSLLFQESSSGGGAEPSFGSGLPLPPGGAGPEDPSLSVTLADIYRELYAFFGDSLATRFGTGQPAPTAPRPPGDKKEPAAAPDSVRKMPQLTASAIVSPHGDESPRGSGGGGPASASGPAASESRPLPRVHRARGAPRQQGPGTGTRDVFQKSRFAPRGAPHFRFIIAGRQAGRRCRGRLFQTAFPAPYGPSPASRYVQKLPMIGRTSRPARRWALSDYSLYLPL

SEQ ID NO: 859373 - protein, 290 aa, Homo sapiens [sequence omitted]

SEQ ID NO: 859374 - protein, 327 aa, Homo sapiens
GRGNECELVSGRRRHRPRRRRLGSSLRHAGVFSSTGAMSEREERRFVEIPRESVRLMAESTGLELSDEVAALLAEDVCYRLREATQNSSQFMKHTKRRKLTVENHVRARRAAVCGDPSGVLSGLPLPPGGAGPEDPSLSVTLADIYRELYAFFGDSLATRFGTGQPAPTAPRPPGDKKEPAAAPDSVRKMPQLTASAIVSPHGDESPRGSGGGGPASASGPAASESRPLPRVHRARGAPRQQGPGTGTRDVFQKSRFAPRGAPHFRFIIAGRQAGRRCRGRLFQTAFPAPYGPSPASRYVQKLPMIGRTSRPARRWALSDYSLYLPL

SEQ ID NO: 859375 - protein, 659 aa, Homo sapiens
GRGNECELVSGRRRHRPRRRRLGSSLRHAGVFSSTGAMSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGSVPSAVSSLTDDLLKYYHQVTRAVLGDDPQLMKVALQDLQTNSKIGALLPYFVYVVSGVKSVSHDLEQLHRLLQVARSLFRNPHLCLGPYVRCLVGSVLYCVLEPLAASINPLNDHWTLRDGAALLLSHIFWTHGDLVSGLYQHILLSLQKILADPVRPLCCHYGAVVGLHALGWKAVERVLYPHLSTYWTNLQAVLDDYSVSNAQVKADGHKVYGAILVAVERLLKMKAQAAEPNRGGPGGRGCRRLDDLPWDSLLFQESSSGGGAEPSFGSGLPLPPGGAGPEDPSLSVTLADIYRELYAFFGDSLATRFGTGQPAPTAPRPPGDKKEPAAAPDSVRKMPQLTASAIVSPHGDESPRGSGGGGPASASGPAASESRPLPRVHRARGAPRQQGPGTGTRDVFQKSRFAPRGAPHFRFIIAGRQAGRRCRGRLFQTAFPAPYGPSPASRYVQKLPMIGRTSRPARRWALSDYSLYLPL

SEQ ID NO: 859376 - protein, 702 aa, Homo sapiens
GRGNECELVSGRRRHRPRRRRLGSSLRHAGVFSSTGAMSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGSVPSAVSSLTDDLLKYYHQVTRAVLGDDPQLMKVALQDLQTNSKIGALLPYFVYVVSGVKSVSHDLEQLHRLLQVARSLFRNPHLCLGPYVRCLVGSVLYCVLEPLAASINPLNDHWTLRDGAALLLSHIFWTHGDLVSGLYQHILLSLQKILADPVRPLCCHYGAVVGLHALGWKAVERVLYPHLSTYWTNLQAVLDDYSVSNAQVKADGHKVYGAILSEYRPLPASLPCMSLAAKQAYFGIFDGPRFLEFFAYLSPWLLQVAVERLLKMKAQAAEPNRGGPGGRGCRRLDDLPWDSLLFQESSSGGGAEPSFGSGLPLPPGGAGPEDPSLSVTLADIYRELYAFFGDSLATRFGTGQPAPTAPRPPGDKKEPAAAPDSVRKMPQLTASAIVSPHGDESPRGSGGGGPASASGPAASESRPLPRVHRARGAPRQQGPGTGTRDVFQKSRFAPRGAPHFRFIIAGRQAGRRCRGRLFQTAFPAPYGPSPASRYVQKLPMIGRTSRPARRWALSDYSLYLPL

SEQ ID NO: 859377 - protein, 290 aa, Homo sapiens [sequence omitted]

SEQ ID NO: 859378 - protein, 937 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 859379 - protein, 951 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 859380 - protein, 951 aa, Homo sapiens; identical to SEQ ID NO: 859379

SEQ ID NO: 859381 - protein, 911 aa, Homo sapiens
MTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 859382 - protein, 515 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQLKK

SEQ ID NO: 859383 - protein, 294 aa, Homo sapiens
LLSLFQLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 859384 - protein, 951 aa, Homo sapiens; identical to SEQ ID NO: 859379

SEQ ID NO: 859385 - protein, 144 aa, Homo sapiens
MSSFALLLSWQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 859386 - protein, 733 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLPQKLFTVQFSSAYSEIERYPRNQDEKKLKPLFLLWIRMWLNIYSLRESRFLFREHHKEDLNLPVWKKMSF

SEQ ID NO: 859387 - protein, 951 aa, Homo sapiens; identical to SEQ ID NO: 859379

SEQ ID NO: 859388 - protein, 951 aa, Homo sapiens; identical to SEQ ID NO: 859379

SEQ ID NO: 859389 - protein, 969 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVKSKENNWMDTSGRENANIMEKGIQAPFKVRKVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 859390 - protein, 951 aa, Homo sapiens; identical to SEQ ID NO: 859379

SEQ ID NO: 859391 - protein, 951 aa, Homo sapiens; identical to SEQ ID NO: 859379

SEQ ID NO: 859392 - protein, 951 aa, Homo sapiens; identical to SEQ ID NO: 859379

SEQ ID NO: 859393 - protein, 951 aa, Homo sapiens; identical to SEQ ID NO: 859379

SEQ ID NO: 859394 - protein, 702 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVSIFLPLFFWLFLVLDMLESFKLFSFLELDLSLMSSSVL

SEQ ID NO: 859395 - protein, 77 aa, Homo sapiens
LGSDLGGGIGGSPAVSAICFFHHEKHCPLFDAFPMYTLSDQPLLLSSTAHQNLYNSIWVVESSIGLLGIVGVMHHMV

SEQ ID NO: 859396 - protein, 145 aa, Homo sapiens
MHTCRDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAP

SEQ ID NO: 859397 - protein, 994 aa, Homo sapiens
MVKPLSIKNTKTSCEWWRTPVVPATRGRELGRVTAPCTPLRGPPSPRVAPSPWAPSSPTGQPPPGAQSSVVIFRFVEKASVRPLNGLPAPGGLSRSWDLGGVSPPRPTPALGPGSNRKLRLEASTSDPLPARGGSALPGSRNLVHGPPAPPQVGADGLYSSLPNGLGGPPERLATLFGGPADTGFLNQGDTWSSPREVSSHAQRIARAKWEFFYGSLDPPSSGAKPPEQAPPSPPGVGSRQGSGVAVGRAAKYSETDLDTVPLRCYRETDIDEVLAEREEADSAIESQPSSEGPPGTAYPPAPRPGPLPGPHPSLGSGNEDEDDDEAGGEEDVDDEVFEASEGARPGSRMPLKSPVPFLPGTSPSADGPDSFSCVFEAILESHRAKGTSYTSLASLEALASPGPTQSPFFTFELPPQPPAPRPDPPAPAPLAPLEPDSGTSSAADGPWTQRGEEEEAEARAKLAPGREPPSPCHSEDSLGLGAAPLGSEPPLSQLVSDSDSELDSTERLALGSTDTLSNGQKADLEAAQRLAKRLYRLDGFRKADVARHLGKNNDFSKLVAGEYLKFFVFTGMTLDQALRVFLKELALMGETQERERVLAHFSQRYFQCNPEALSSEDGAHTLDLCAHAAQHGSPRHNIGKRMTCGDFIGNLEGLNDGGDFPRELLKALYSSIKNEKLQWAIDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 859398 - protein, 393 aa, Homo sapiens
MIGVNSIHSSAGRLRSRSLCSVRYGRTHRGAETLCYGWPQRSRSLKPVLYTDLVVSRLQSRKKKKAALYSSIKNEKLQWAIDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 859399 - protein, 232 aa, Homo sapiens [sequence omitted]

SEQ ID NO: 859400 - protein, 1092 aa, Homo sapiens
CDKSGAVPFSTTRSPRRPSPRSAGPSLSSVSPRSQLWASSGLSEEHAAPLLPAWPRHPCPPSLTPGPSMAQGAMRFCSEGDCAISPPRCPRRWLPEGPVPQSPPASMYGSTGSLLRRVAGPGPRGRELGRVTAPCTPLRGPPSPRVAPSPWAPSSPTGQPPPGAQSSVVIFRFVEKASVRPLNGLPAPGGLSRSWDLGGVSPPRPTPALGPGSNRKLRLEASTSDPLPARGGSALPGSRNLVHGPPAPPQVGADGLYSSLPNGLGGPPERLATLFGGPADTGFLNQGDTWSSPREVSSHAQRIARAKWEFFYGSLDPPSSGAKPPEQAPPSPPGVGSRQGSGVAVGRAAKYSETDLDTVPLRCYRETDIDEVLAEREEADSAIESQPSSEGPPGTAYPPAPRPGPLPGPHPSLGSGNEDEDDDEAGGEEDVDDEVFEASEGARPGSRMPLKSPVPFLPGTSPSADGPDSFSCVFEAILESHRAKGTSYTSLASLEALASPGPTQSPFFTFELPPQPPAPRPDPPAPAPLAPLEPDSGTSSAADGPWTQRGEEEEAEARAKLAPGREPPSPCHSEDSLGLGAAPLGSEPPLSQLVSDSDSELDSTERLALGSTDTLSNGQKADLEAAQRLAKRLYRLDGFRKADVARHLGKNNDFSKLVAGEYLKFFVFTGMTLDQALRVFLKELALMGETQERERVLAHFSQRYFQCNPEALSSEDGAHTLDLCAHAAQHGSPRHNIGKRMTCGDFIGNLEGLNDGGDFPRELLKALYSSIKNEKLQWAIDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 859401 - protein, 1091 aa, Homo sapiens
REGLRGGRAWSKREPRCLHSSAGPSLSSVSPRSQLWASSGLSEEHAAPLLPAWPRHPCPPSLTPGPSMAQGAMRFCSEGDCAISPPRCPRRWLPEGPVPQSPPASMYGSTGSLLRRVAGPGPRGRELGRVTAPCTPLRGPPSPRVAPSPWAPSSPTGQPPPGAQSSVVIFRFVEKASVRPLNGLPAPGGLSRSWDLGGVSPPRPTPALGPGSNRKLRLEASTSDPLPARGGSALPGSRNLVHGPPAPPQVGADGLYSSLPNGLGGPPERLATLFGGPADTGFLNQGDTWSSPREVSSHAQRIARAKWEFFYGSLDPPSSGAKPPEQAPPSPPGVGSRQGSGVAVGRAAKYSETDLDTVPLRCYRETDIDEVLAEREEADSAIESQPSSEGPPGTAYPPAPRPGPLPGPHPSLGSGNEDEDDDEAGGEEDVDDEVFEASEGARPGSRMPLKSPVPFLPGTSPSADGPDSFSCVFEAILESHRAKGTSYTSLASLEALASPGPTQSPFFTFELPPQPPAPRPDPPAPAPLAPLEPDSGTSSAADGPWTQRGEEEEAEARAKLAPGREPPSPCHSEDSLGLGAAPLGSEPPLSQLVSDSDSELDSTERLALGSTDTLSNGQKADLEAAQRLAKRLYRLDGFRKADVARHLGKNNDFSKLVAGEYLKFFVFTGMTLDQALRVFLKELALMGETQERERVLAHFSQRYFQCNPEALSSEDGAHTLDLCAHAAQHGSPRHNIGKRMTCGDFIGNLEGLNDGGDFPRELLKALYSSIKNEKLQWAIDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 859402 - protein, 929 aa, Homo sapiens
VRQIWRCPLQHHAESAPPLPALSWAQPLLCLSSVSALGEQRPTPALGPGSNRKLRLEASTSDPLPARGGSALPGSRNLVHGPPAPPQVGADGLYSSLPNGLGGPPERLATLFGGPADTGFLNQGDTWSSPREVSSHAQRIARAKWEFFYGSLDPPSSGAKPPEQAPPSPPGVGSRQGSGVAVGRAAKYSETDLDTVPLRCYRETDIDEVLAEREEADSAIESQPSSEGPPGTAYPPAPRPGPLPGPHPSLGSGNEDEDDDEAGGEEDVDDEVFEASEGARPGSRMPLKSPVPFLPGTSPSADGPDSFSCVFEAILESHRAKGTSYTSLASLEALASPGPTQSPFFTFELPPQPPAPRPDPPAPAPLAPLEPDSGTSSAADGPWTQRGEEEEAEARAKLAPGREPPSPCHSEDSLGLGAAPLGSEPPLSQLVSDSDSELDSTERLALGSTDTLSNGQKADLEAAQRLAKRLYRLDGFRKADVARHLGKNNDFSKLVAGEYLKFFVFTGMTLDQALRVFLKELALMGETQERERVLAHFSQRYFQCNPEALSSEDGAHTLDLCAHAAQHGSPRHNIGKRMTCGDFIGNLEGLNDGGDFPRELLKALYSSIKNEKLQWAIDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 859403 - protein, 1117 aa, Homo sapiens
CDKSGAVPFSTTRSPRRPSPRSAGPSLSSVSPRSQLWASSGLSEEHAAPLLPAWPRHPCPPSLTPGPSMAQGAMRFCSEGDCAISPPRCPRRWLPEGPVPQSPPASMYGSTGSLLRRVAGPGPRGRELGRVTAPCTPLRGPPSPRVAPSPWAPSSPTGQPPPGAQSSVVIFRFVEKASVRPLNGLPAPGGLSRSWDLGGVSPPRPTPALGPGSNRKLRLEASTSDPLPARGGSALPGSRNLVHGPPAPPQVGADGLYSSLPNGLGGPPERLATLFGGPADTGFLNQGDTWSSPREVSSHAQRIARAKWEFFYGSLDPPSSGAKPPEQAPPSPPGVGSRQGSGVAVGRAAKYSETDLDTVPLRCYRETDIDEVLAEREEADSAIESQPSSEGPPGTAYPPAPRPGPLPGPHPSLGSGNEDEDDDEAGGEEDVDDEVFEASEGARPGSRMPLKSPVPFLPGTSPSADGPDSFSCVFEAILESHRAKGTSYTSLASLEALASPGPTQSPFFTFELPPQPPAPRPDPPAPAPLAPLEPDSGTSSAADGPWTQRGEEEEAEARAKLAPGREPPSPCHSEDSLGLGAAPLGSEPPLSQLVSDSDSELDSTERLALGSTDTLSNGQKADLEAAQRLAKRLYRLDGFRKADVARHLGKNNDFSKLVAGEYLKFFVFTGMTLDQALRVFLKELALMGETQERERVLAHFSQRYFQCNPEALSSEDGAHTLDLCAHAAQHGSPRHNIGKRMTCGDFIGNLEGLNDGGDFPRELLKALYSSIKNEKLQWAMATEARTEAGAAAPWPAPSEVITTCRDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 859404 - protein, 232 aa, Homo sapiens [sequence omitted]

SEQ ID NO: 859405 - protein, 232 aa, Homo sapiens [sequence omitted]

SEQ ID NO: 859406 - protein, 76 aa, Homo sapiens
MPCMFHLSSAVRPKPEVGLHLSIWGDSAWPNSGGDCSRRERCSRKKGLAEQTGPKEGCAQYTVPSLHMPRDLTPFY

SEQ ID NO: 859407 - protein, 111 aa, Homo sapiens
MPCMFHLSSAVRPKPEVGLHLSIWGDSAWPNSGGDCSRRERCSRKKGLAEQTGPKEGCARSGNNKWFSNSIVPSSNQQTAGWLQIFHPPTKAASNPCLCSGGGNLCLLQSL

SEQ ID NO: 859408 - protein, 66 aa, Homo sapiens
RLSCCSGERVGTGLEEMLQAFSTQSGMNLEWSQKCLQDNNWDYTRSAQAFTHLKAKGEIPEVAFMK

SEQ ID NO: 859409 - protein, 619 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 859410 - protein, 619 aa, Homo sapiens; identical to SEQ ID NO: 859409

SEQ ID NO: 859411 - protein, 619 aa, Homo sapiens; identical to SEQ ID NO: 859409

SEQ ID NO: 859412 - protein, 619 aa, Homo sapiens; identical to SEQ ID NO: 859409

SEQ ID NO: 859413 - protein, 526 aa, Homo sapiens [sequence omitted]

SEQ ID NO: 859414 - protein, 605 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 859415 - protein, 374 aa, Homo sapiens
ALRPDGESTLLAPVNNAFSDDTLSMDQRLLKLILQNHILKVKVGLNELYNWANTGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 859416 - protein, 275 aa, Homo sapiens
SSVPPEVDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 859417 - protein, 587 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQK

SEQ ID NO: 859418 - protein, 106 aa, Homo sapiens
MLTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 859419 - protein, 79 aa, Homo sapiens
PRPSLLAKLPSAPTPSSSPVPTLSPEQQEMLQAFSTQSGMNLEWSQKCLQDNNWDYTRSAQAFTHLKAKGEIPEVAFMK

SEQ ID NO: 859420 - protein, 176 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYEITSWLNHYVNSRRLQVDNMEA

SEQ ID NO: 859421 - protein, 619 aa, Homo sapiens; identical to SEQ ID NO: 859409

SEQ ID NO: 859422 - protein, 619 aa, Homo sapiens; identical to SEQ ID NO: 859409

SEQ ID NO: 859423 - protein, 619 aa, Homo sapiens; identical to SEQ ID NO: 859409

SEQ ID NO: 859424 - protein, 512 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPAHCCVFLSMESSRKWTESPGILCEPSPGHSLLFLLAIQGYVL

SEQ ID NO: 859425 - protein, 605 aa, Homo sapiens; identical to SEQ ID NO: 859414

SEQ ID NO: 859426 - protein, 254 aa, Homo sapiens
MSYPHQLPLMLKPPRRYRPARRKLFWTQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 859427 - protein, 265 aa, Homo sapiens
LTVSPRLECNGVILAHCNLCLPGFKGFSCLSLPSSWDYRYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 859428 - protein, 356 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYIRSVVACVSPPGDLHPLGG

SEQ ID NO: 859429 - protein, 106 aa, Homo sapiens; identical to SEQ ID NO: 859418

SEQ ID NO: 859430 - protein, 110 aa, Homo sapiens
ARYPLVHGWLLVHGWLLVHGWLLVHGCLPENICLPTKLRLPTNPCLPISPGLPASPGLPASARLPTSPRLPASLCLPASSCLPTTTQSSINWLNIHSSVLPRHLSQPWTS

SEQ ID NO: 859431 - protein, 209 aa, Homo sapiens
TFPQVTGLPTNSGSSSDFKSSSNGVTGFQAKPMSSKTIHVFQKILVFPQIHSFRKIQVFQEIRVFQQIHVFQQSHVFHQINVFQPTCVFQQRYVFQQRYVFQQRYVFQQRYVFQKIHVFQPSHVFQKIHVFQKIYVFQLSYVFQQIHVFLYLQVFQHLQGFQHLLVFQHLHVFQHLCVFQHLHVFQQLPSLPSTGSISMSSNVSSVLIF

SEQ ID NO: 859432 - protein, 209 aa, Homo sapiens; identical to SEQ ID NO: 859431

SEQ ID NO: 859433 - protein, 146 aa, Homo sapiens
TFPQVTGLPTNSGSSSDFKSSSKVSLASKQSLCLPGLSMSSRKSLSSLKSIASEKSRSSRKSVSSSKSTSSNKAMSSIKLMSSSLLVSSNKGRSSSISRASSICSSSNISTSSSISVSSSIFMSSNNYPVFHQLAQYPCLPTSPVC

SEQ ID NO: 859434 - protein, 161 aa, Homo sapiens
TFPQVTGLPTNSGSSSDFKSSSNGVTGFQAKPMSSKTIHVFQKILVFPQIHSFRKIQVFQEIRVFQQIHVFQQSHVFHQINVFQPTCVFQQRYVFQQRYVFQQRYVFQQRYVFQKIHVFQPSHVFQKIHVFQKIYVFQLLPSLPSTGSISMSSNVSSVLIF

SEQ ID NO: 859435 - protein, 209 aa, Homo sapiens; identical to SEQ ID NO: 859431

SEQ ID NO: 859436 - protein, 204 aa, Homo sapiens
MSSRKSMSSSNLPVFQKIHVFPTIQVFRIIWVFLKIYVFQKSHVFQKHIPHLPMASRSSRLSMSSRKSLSSLKSIASKKSGSSRKSVSSSKSTSSNKAMSSRLSMSSRKSLSSLKSIASEKSRSSRKSVSSSKSTSSNKAMSSIKLMSSSLLVSSNKGTSSNKGTSSNKGMSSNKGTSSRKSTSSNQAMSSRKSTSSRKYMSSN

SEQ ID NO: 859437 - protein, 204 aa, Homo sapiens; identical to SEQ ID NO: 859436

SEQ ID NO: 859438 - protein, 209 aa, Homo sapiens; identical to SEQ ID NO: 859431

SEQ ID NO: 859439 - protein, 204 aa, Homo sapiens; identical to SEQ ID NO: 859436

SEQ ID NO: 859440 - protein, 199 aa, Homo sapiens
YCCVMEKELQLRLCYASLTGEYKPLISATLGISSSKKAMSSRNNPHLPMASRSSRLSMSSRKSLSSLKSIASKKSGSSRKSVSSSKSTSSNKAMSSRLSMSSRKSLSSLKSIASEKSRSSRKSVSSSKSTSSNKAMSSIKLMSSSLLVSSNKGTSSNKGTSSNKGMSSNKGTSSRKSTSSNQAMSSRKSTSSRKYMSSN

SEQ ID NO: 859441 - protein, 209 aa, Homo sapiens; identical to SEQ ID NO: 859431

SEQ ID NO: 859442 - protein, 242 aa, Homo sapiens
EEDLDLFLEDMMDWKIQILLEELDILEDWDWVEDRDFSGRHGLAGRSVLDGRPGNYWKRWISCKICVFHLIHVFQKILVFPQIHSFRKIQVFQEIRVFQQIHVFQQSHVFHQINVFQPTCVFQQRYVFQQRYVFQQRYVFQQRYVFQKIHVFQPSHVFQKIHVFQKIYVFQLSYVFQQIHVFLYLQVFQHLQGFQHLLVFQHLHVFQHLCVFQHLHVFQQLPSLPSTGSISMSSNVSSVLIF

SEQ ID NO: 859443 - protein, 209 aa, Homo sapiens; identical to SEQ ID NO: 859431

SEQ ID NO: 859444 - protein, 209 aa, Homo sapiens; identical to SEQ ID NO: 859431

SEQ ID NO: 859445 - protein, 252 aa, Homo sapiens
TFPQVTGLPTNSGSSSDFKSSSNGVTGFQAKPMSSKTIHVFQKILVFPQIHSFRKIQVFQEIRVFQQIHVFQQSHVFHQINVFQPTCVFQQRYVFQQRYVFQQRYVFQQRYVFQKIHVFQPSHVFQKIHVFQKIYVFQLSYVFQQIHVFLYLQVFQHLQGFQHLLVFQHLHVFQHLCVFQHLHVFQQLPSLPSTGSISMSSNVSSVLIFQEAPSLPVNQVFQQIQSSSNYWSSTKSRSSRKIHVFQEIHVFQ

SEQ ID NO: 859446 - protein, 209 aa, Homo sapiens; identical to SEQ ID NO: 859431

SEQ ID NO: 859447 - protein, 209 aa, Homo sapiens; identical to SEQ ID NO: 859431

SEQ ID NO: 859448 - protein, 209 aa, Homo sapiens; identical to SEQ ID NO: 859431

SEQ ID NO: 859449 - protein, 206 aa, Homo sapiens
ARYPLVHGWLLRVFQEIRVFQQVHVFQQSHVFQTIHVFQKILVFPQIHSFRKIQVFQEIRVFQQIHVFQQSHVFHQINVFQPTCVFQQRYVFQQRYVFQQRYVFQQRYVFQKIHVFQPSHVFQKIHVFQKIYVFQLSYVFQQIHVFLYLQVFQHLQGFQHLLVFQHLHVFQHLCVFQHLHVFQQLPSLPSTGSISMSSNVSSVLIF

SEQ ID NO: 859450 - protein, 189 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCTETGFHHGAQAGLTGGSRQ

SEQ ID NO: 859451 - protein, 142 aa, Homo sapiens
MNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCTAGVQWRDLG

SEQ ID NO: 859452 - protein, 209 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCTGGLRGIARGGLTGLTLTSLYALYNNWEHMKGSLLQQSL

SEQ ID NO: 859453 - protein, 261 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCTDRVLPCCLGCSQTPELKPASASQSAGITCVSHHAWPSLIFKVNIWRTHPESKGGLRGIARGGLTGLTLTSLYALYNNWEHMKGSLLQQSL

SEQ ID NO: 859454 - protein, 222 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEGMLYKCTETGFHHGAQASLKLLSSSDPPCLGLPSIGITGGLRGIARGGLTGLTLTSLYALYNNWEHMKGSLLQQSL

SEQ ID NO: 859455 - protein, 190 aa, Homo sapiens
MEGGGGSGNKTTGGLAGFFGAGGAGYSHADLAGVPLTGMNPLSPYLNVDPRYLVQDTDEFILPTGANRAAFGAMNGLRLGLKETQNMAWSKPRNVQILNMVTRQGALWANTLGSLALLYSAFGVIIEKTRGAEDDLNTVAAGTMTGMLYKCTGGLRGIARGGLTGLTLTSLYALYNNWEHMKGSLLQQSL

SEQ ID NO: 859456 - protein, 105 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETRF

SEQ ID NO: 859457 - protein, 172 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGALWANTLGSLALLYSAFGVIIEKTRGAEDDLNTVAAGTMTGMLYKCTGGLRGIARGGLTGLTLTSLYALYNNWEHMKGSLLQQSL

SEQ ID NO: 859458 - protein, 175 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCTGEYC

SEQ ID NO: 859459 - protein, 130 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNHLLPEFRSCLLVLYHQVHSFNDPKL

SEQ ID NO: 859460 - protein, 188 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCTVSEMALDSPFCVLLSGS

SEQ ID NO: 859461 - protein, 209 aa, Homo sapiens; identical to SEQ ID NO: 859452

SEQ ID NO: 859462 - protein, 240 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCTETGFHHGAQASLKLLSSSDPPCLGLPSIGITGGLRGIARGGLTGLTLTSLYALYNNWEHMKGSLLQQSL

SEQ ID NO: 859463 - protein, 125 aa, Homo sapiens
MTGAAFGAMNGLRLGLKETQNMAWSKPRNVQILNMVTRQGALWANTLGSLALLYSAFGVIIEKTRGAEDDLNTVAAGTMTGMLYKCTGGLRGIARGGLTGLTLTSLYALYNNWEHMKGSLLQQSL

SEQ ID NO: 859464 - protein, 141 aa, Homo sapiens
MTNLKWELAFFTIGGCCMRAAFGAMNGLRLGLKETQNMAWSKPRNVQILNMVTRQGALWANTLGSLALLYSAFGVIIEKTRGAEDDLNTVAAGTMTGMLYKCTGGLRGIARGGLTGLTLTSLYALYNNWEHMKGSLLQQSL

SEQ ID NO: 859465 - protein, 118 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVHFAL

SEQ ID NO: 859466 - protein, 225 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCTDRVLPCCLGCSQTPELKPASASQSAGITCVSHHAWPSLIFKVNIWRTHPESKGC

SEQ ID NO: 859467 - protein, 115 aa, Homo sapiens
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQ

SEQ ID NO: 859468 - protein, 263 aa, Homo sapiens
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGYQPQLCRHHSLPHA

SEQ ID NO: 859469 - protein, 112 aa, Homo sapiens [sequence omitted]

SEQ ID NO: 859470 - protein, 166 aa, Homo sapiens
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQKRRGFTVLARMVSIS

SEQ ID NO: 859471 - protein, 263 aa, Homo sapiens; identical to SEQ ID NO: 859468

SEQ ID NO: 859472 - protein, 227 aa, Homo sapiens
MPGLLLCEPTELYNILNQATKLSRLTDPNYLCLLDVRSKWEYDESHVITALRVKKGLNYFTFPPTVYLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGYQPQLCRHHSLPHA

SEQ ID NO: 859473 - protein, 61 aa, Homo sapiens
MGEDYPWRFHHKHHGSALLIFSEAHRRVLKSLTWGHFVGGGPECVYPGLSGRRRPLLPESL

SEQ ID NO: 859474 - protein, 167 aa, Homo sapiens
MPGLLLCEPTELYNILNQATKLSRLTDPNYLCLLDVRSKWEYDESHVITALRVKKELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGYQPQLCRHHSLPHA

SEQ ID NO: 859475 - protein, 318 aa, Homo sapiens
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEVLGLCQEVQKQHVSKSGIGEPAAGMGEDYPWRFHHKHHGSALLIFSEAHRRVLKSLTWGHFVGGGPECVYPGLSGRRRPLLPESL

SEQ ID NO: 859476 - protein, 180 aa, Homo sapiens
MMMMIQTLMVMAKELDAFQPYPIEIVPGKVFVGNFSQACDPKIQKDLKIKAHVNVSMDTGPFFAGDADKLLHIRIEDSPEAQILPFLRHMCHFIEVLGLCQEVQKQHVSKSGIGEPAAGMGEDYPWRFHHKHHGSALLIFSEAHRRVLKSLTWGHFVGGGPECVYPGLSGRRRPLLPESL

SEQ ID NO: 859477 - protein, 247 aa, Homo sapiens
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIGYQPQLCRHHSLPHA

SEQ ID NO: 859478 - protein, 115 aa, Homo sapiens
MPQELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGYQPQLCRHHSLPHA

SEQ ID NO: 859479 - protein, 124 aa, Homo sapiens
AGVQWHSHSSLQPRFPGIKPSSHLSLRSGWNCKHEAPRLFAPRTPGSGGCWTGLPGSVASTGSWRPWRMTTSRMTPTRDSLSSARDCLSLMTMRTLERKRRKPEVIILNFASEKTFRPCWRSRT

SEQ ID NO: 859480 - protein, 314 aa, Homo sapiens
AASDQPDSAATTEKAKKIKNLKKKLRQVEELQQRIQAGEVSQPSKEQLEKLARRRALEEELEDLELASEALGNREWTAEQTVGLSGVWGNTGNSSQEGYPPYWLPPPAAQLCPPEPSVSLNPSLFFPTSTFGLSPTHLIFFKQDTQISSKGTLGSSTRRPMVEKKTSVRSQDPGQRRVLDRAARQRRINRQLEALENDNFQDDPHAGLPQLGKRLPQFDDDADTGKKKKKTRGDHFKLRFRKNFQALLEEQNLSVAEGPNYLTACAGPPSRPQRPFCAVCGFPSPYTCVSCGARYCTVRCLGTHQETRCLKWTV

SEQ ID NO: 859481 - protein, 154 aa, Homo sapiens
MVEKKTSVRSQDPGQRRVLDRAARQRRINRQLEALENDNFQDDPHAGLPQLGKRLPQFDDDADTGKKKKKTRGDHFKLRFRKNFQALLEEQNLSVAEGPNYLTACAGPPSRPQRPFCAVCGFPSPYTCVSCGARYCTVRCLGTHQETRCLKWTV

SEQ ID NO: 859482 - protein, 154 aa, Homo sapiens; identical to SEQ ID NO: 859481

SEQ ID NO: 859483 - protein, 202 aa, Homo sapiens
LECSGIVIAHCSLDFLGSNHPPTSASGVAGTASMRPHAWLIFNLLCGDGLSLCCPVRSQDPGQRRVLDRAARQRRINRQLEALENDNFQDDPHAGLPQLGKRLPQFDDDADTGKKKKKTRGDHFKLRFRKNFQALLEEQNLSVAEGPNYLTACAGPPSRPQRPFCAVCGFPSPYTCVSCGARYCTVRCLGTHQETRCLKWTV

SEQ ID NO: 859484 - protein, 124 aa, Homo sapiens; identical to SEQ ID NO: 859479

SEQ ID NO: 859485 - protein, 154 aa, Homo sapiens; identical to SEQ ID NO: 859481

SEQ ID NO: 859486 - protein, 154 aa, Homo sapiens; identical to SEQ ID NO: 859481

SEQ ID NO: 859487 - protein, 154 aa, Homo sapiens; identical to SEQ ID NO: 859481

SEQ ID NO: 859488 - protein, 154 aa, Homo sapiens; identical to SEQ ID NO: 859481

SEQ ID NO: 859489 - protein, 314 aa, Homo sapiens; identical to SEQ ID NO: 859480

SEQ ID NO: 859490 - protein, 155 aa, Homo sapiens [sequence omitted]

SEQ ID NO: 859491 - protein, 154 aa, Homo sapiens; identical to SEQ ID NO: 859481

SEQ ID NO: 859492 - protein, 154 aa, Homo sapiens; identical to SEQ ID NO: 859481

SEQ ID NO: 859493 - protein, 1204 aa, Homo sapiens
MNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMELQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQLTWIALKFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 859494 - protein, 1220 aa, Homo sapiens
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMELQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 859495 - protein, 1008 aa, Homo sapiens
MFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 859496 - protein, 668 aa, Homo sapiens
PPGFKRFSCLSLLSSWDYKGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 859497 - protein, 227 aa, Homo sapiens
MADLLGSILSSMEKPPSLGDQETRRKAREQAARLKKLQEQEKQQKVEFRKRMEKEVSDFIQDSGQIKKKFQPMNKIERSILHDVVEVAGLTSFSFGEDDDCRYVMIFKKEFAPSDEELDSYRRGEEWDPQKAEEKRKLKELAQRQEEEAAQQGPVVVSPASDYKDKYSHLIGKGAAKDAAHMLQANKTYGCVPVANKRDTRSIEEAMNEIRAKKRLRQSGEELPPTS

SEQ ID NO: 859498 - protein, 227 aa, Homo sapiens; identical to SEQ ID NO: 859497

SEQ ID NO: 859499 - protein, 1220 aa, Homo sapiens; identical to SEQ ID NO: 859494

SEQ ID NO: 859500 - protein, 1220 aa, Homo sapiens; identical to SEQ ID NO: 859494

SEQ ID NO: 859501 - protein, 1220 aa, Homo sapiens; identical to SEQ ID NO: 859494

SEQ ID NO: 859502 - protein, 1220 aa, Homo sapiens; identical to SEQ ID NO: 859494

SEQ ID NO: 859503 - protein, 1220 aa, Homo sapiens; identical to SEQ ID NO: 859494

SEQ ID NO: 859504 - protein, 1131 aa, Homo sapiens
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMELQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQVRPFSLKSVTSNPPTHTHA

SEQ ID NO: 859505 - protein, 907 aa, Homo sapiens
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMELQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPALQPGRQSKTLSQKKK

SEQ ID NO: 859506 - protein, 975 aa, Homo sapiens
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMELQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVLLILMELWGLEVE

SEQ ID NO: 859507 - protein, 117 aa, Homo sapiens
TPAPGTCTVPRPPRARGLCSRLLQNIPLCGRDPPTSEVLLGPPLRRGAAQSAKRPIRRRPSAAQGPAPAPHPGRLPSQDCAPAPWGGVLTPTPASLHIAEPDGPPPISILDTWRSPC

SEQ ID NO: 859508 - protein, 275 aa, Homo sapiens
MPSVRSIFCFFHQRLLSHQEAGPGSPEDHEIPAALPTQDEGTEAEKEKHISLQNNYEKSQETFKQLQSDFYGRESELLATRQDLKSVEEKLSLATGGLDFKQKSILWKLKLIDSQNLKTAKANMWSRIQQERTAIAGAIVKHYKTFRKEPGPERKRTWYTEKEIGIQYKDWFYRKKIWKALERYSRPKRLYQGKKEGTKQFPGNKILRPFKFRNQRFPLGIALPRIQPTVPNLPTSHVGRALVTGLLPEGQLIHSLLLETPKGLGSRRRRYYGNC

SEQ ID NO: 859509 - protein, 1197 aa, Homo sapiens
MNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMELQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 859510 - protein, 1215 aa, Homo sapiens
MNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMEEQGRVGEQTSPPPTPACLLQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 859511 - protein, 1185 aa, Homo sapiens
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMELQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPVLNFDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 859512 - protein, 842 aa, Homo sapiens [sequence omitted]

SEQ ID NO: 859513 - protein, 1227 aa, Homo sapiens
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMELQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQLTWIALKFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 859514 - protein, 1220 aa, Homo sapiens; identical to SEQ ID NO: 859494

SEQ ID NO: 859515 - protein, 1220 aa, Homo sapiens; identical to SEQ ID NO: 859494

SEQ ID NO: 859516 - protein, 176 aa, Homo sapiens
MEKEVSDFIQDSGQIKKKFQPMNKIERSILHDVVEVAGLTSFSFGEDDDCRYVMIFKKEFAPSDEELDSYRRGEEWDPQKAEEKRKLKELAQRQEEEAAQQGPVVVSPASDYKDKYSHLIGKGAAKDAAHMLQANKTYGCVPVANKRDTRSIEEAMNEIRAKKRLRQSGEELPPTS

SEQ ID NO: 859517 - protein, 1220 aa, Homo sapiens; identical to SEQ ID NO: 859494

SEQ ID NO: 859518 - protein, 1220 aa, Homo sapiens; identical to SEQ ID NO: 859494

SEQ ID NO: 859519 - protein, 1131 aa, Homo sapiens; identical to SEQ ID NO: 859504

SEQ ID NO: 859520 - protein, 710 aa, Homo sapiens
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMELQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHPHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQECGDWKLGLRAGG

SEQ ID NO: 859521 - protein, 510 aa, Homo sapiens
MEEPQAGDAARFSCPPNFTAKPPASESPRFSLEALTGPDTELWLIQAPADFAPECFNGRHVPLSGSQIVKGKLAGKRHRYRVLSSCPQAGEATLLAPSTEAGGGLTCASAPQGTLRILEGPQQSLSGSPLQPIPASPPPQIPPGLRPRFCAFGGNPPVTGPRSALAPNLLTSGKKKKEMQVTEAPVTQEAVNGHGALEVDMALGSPEMDVRKKKKKKNQQLKEPEAAGPVGTEPTVETLEPLGVLFPSTTKKRKKPKGKETFEPEDKTVKQEQINTEPLEDTVLSPTKKRKRQKGTEGMEPEEGVTVESQPQVKVEPLEEAIPLPPTKKRKKEKGQMAMMEPGTEAMEPVEPEMKPLESPGGTMAPQQPEGAKPQAQAALAAPKKKTKKEKQQDATVEPETEVVGPELPDDLEPQAAPTSTKKKKKKKERGHTVTEPIQPLEPELPGEGQPEARATPGSTKKRKKQSQESRMPETVPQEEMPGPPLNSESGEEAPTGRDKKRKQQQQQPV

SEQ ID NO: 859522 - protein, 497 aa, Homo sapiens
MPLHSSLGNRARLSQKKTKKKSKNLPSPVPLKPLPSLFLSVSFNGRHVPLSGSQIVKGKLAGKRHRYRVLSSCPQAGEATLLAPSTEAGGGLTCASAPQGTLRILEGPQQSLSGSPLQPIPASPPPQIPPGLRPRFCAFGGNPPVTGPRSALAPNLLTSGKKKKEMQVTEAPVTQEAVNGHGALEVDMALGSPEMDVRKKKKKKNQQLKEPEAAGPVGTEPTVETLEPLGVLFPSTTKKRKKPKGKETFEPEDKTVKQEQINTEPLEDTVLSPTKKRKRQKGTEGMEPEEGVTVESQPQVKVEPLEEAIPLPPTKKRKKEKGQMAMMEPGTEAMEPVEPEMKPLESPGGTMAPQQPEGAKPQAQAALAAPKKKTKKEKQQDATVEPETEVVGPELPDDLEPQAAPTSTKKKKKKKERGHTVTEPIQPLEPELPGEGQPEARATPGSTKKRKKQSQESRMPETVPQEEMPGPPLNSESGEEAPTGRDKKRKQQQQQPV

SEQ ID NO: 859523 - protein, 487 aa, Homo sapiens
MVSGLVDGKEGPGPDPKSGFLNLSQERIEVSHFNGRHVPLSGSQIVKGKLAGKRHRYRVLSSCPQAGEATLLAPSTEAGGGLTCASAPQGTLRILEGPQQSLSGSPLQPIPASPPPQIPPGLRPRFCAFGGNPPVTGPRSALAPNLLTSGKKKKEMQVTEAPVTQEAVNGHGALEVDMALGSPEMDVRKKKKKKNQQLKEPEAAGPVGTEPTVETLEPLGVLFPSTTKKRKKPKGKETFEPEDKTVKQEQINTEPLEDTVLSPTKKRKRQKGTEGMEPEEGVTVESQPQVKVEPLEEAIPLPPTKKRKKEKGQMAMMEPGTEAMEPVEPEMKPLESPGGTMAPQQPEGAKPQAQAALAAPKKKTKKEKQQDATVEPETEVVGPELPDDLEPQAAPTSTKKKKKKKERGHTVTEPIQPLEPELPGEGQPEARATPGSTKKRKKQSQESRMPETVPQEEMPGPPLNSESGEEAPTGRDKKRKQQQQQPV

SEQ ID NO: 859524 - protein, 510 aa, Homo sapiens; identical to SEQ ID NO: 859521

SEQ ID NO: 859525 - protein, 520 aa, Homo sapiens
MWTGKEVSVDPISPSAADAARFSCPPNFTAKPPASESPRFSLEALTGPDTELWLIQAPADFAPECFNGRHVPLSGSQIVKGKLAGKRHRYRVLSSCPQAGEATLLAPSTEAGGGLTCASAPQGTLRILEGPQQSLSGSPLQPIPASPPPQIPPGLRPRFCAFGGNPPVTGPRSALAPNLLTSGKKKKEMQVTEAPVTQEAVNGHGALEVDMALGSPEMDVRKKKKKKNQQLKEPEAAGPVGTEPTVETLEPLGVLFPSTTKKRKKPKGKETFEPEDKTVKQEQINTEPLEDTVLSPTKKRKRQKGTEGMEPEEGVTVESQPQVKVEPLEEAIPLPPTKKRKKEKGQMAMMEPGTEAMEPVEPEMKPLESPGGTMAPQQPEGAKPQAQAALAAPKKKTKKEKQQDATVEPETEVVGPELPDDLEPQAAPTSTKKKKKKKERGHTVTEPIQPLEPELPGEGQPEARATPGSTKKRKKQSQESRMPETVPQEEMPGPPLNSESGEEAPTGRDKKRKQQQQQPV

SEQ ID NO: 859526 - protein, 436 aa, Homo sapiens
MGLARALRRLSGALDSGDSRAGDEEEAGPGLCRNGWAPAPVQSPVGRRRGRFVKKDGHCNVRFVNLGGQGARYLSDLFTTCVDVRWRWMCLLFSCSFLASWLLFGLAFWLIASLHGDLAAPPPPAPCFSHVASFLAAFLFALETQTSIGYGVRSVTEECPAAVAAVVLQCIAGCVLDAFVVGAVMAKMAKPKKRNETLVFSENAVVALRDHRLCLMWRVGNLRRSHLVEAHVRAQLLQPRVTPEGEYIPLDHQDVDVGFDGGTDRIFLVSPITIVHEIDSASPLYELGRAELARADFELVVILEGMVEATAMTTQCRSSYLPGELLWGHRFEPVLFQRGSQYEVDYRHFHRTYEVPGTPVCSAKELDERAEQASHSLKSSFPGSLTAFCYENELALSCCQEEDEDDETEEGNGVETEDGAASPRVLTPTLALTLPP

SEQ ID NO: 859527 - protein, 1032 aa, Homo sapiens
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQPGSQVLPPPPTTLNGPGASPLPLPMYRPDGLSGPPPPNAQYQPPPLPGQTLGAGYPPQQANSGPQMAGAQLSYPGGFPGGPAQMAGPPQPQKKLDPDSIPSPIQVIENDRASRGGQVYATNTRGQIPPLVTTDCMIQDQGNASPRFIRCTTYCFPCTSDMAKQAQIPLAAVIKPFATIPSNESPLYLVNHGESGPVRCNRCKAYMCPFMQFIEGGRRYQCGFCNCVNDVPPFYFQHLDHIGRRLDHYEKPELSLGSYEYVATLDYCRKSKPPNPPAFIFMIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQLILPDSMKVLPVYMNCLLKNCVLLSRPEISTDERAYQRQLVMTMGVADSQLFFYPQLLPIHTLDVKSTMLPAAVRCSESRLSEEGIFLLANGLHMFLWLGVSSPPELIQGIFNVPSFAHINTDMTLLPEVGNPYSQQLRMIMGIIQQKRPYSMKLTIVKQREQPEMVFRQFLVEDKGLYGGSSYVDFLCCVHKEICQLLN

SEQ ID NO: 859528 - protein, 1032 aa, Homo sapiens; identical to SEQ ID NO: 859527

SEQ ID NO: 859529 - protein, 385 aa, Homo sapiens
HFDKMANIQKFDQYNTFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQLILPDSMKVLPVYMNCLLKNCVLLSRPEISTDERAYQRQLVMTMGVADSQLFFYPQLLPIHTLDVKSTMLPAAVRCSESRLSEEGIFLLANGLHMFLWLGVSSPPELIQGIFNVPSFAHINTDMTLLPEVGNPYSQQLRMIMGIIQQKRPYSMKLTIVKQREQPEMVFRQFLVEDKGLYGGSSYVDFLCCVHKEICQLLN

SEQ ID NO: 859530 - protein, 217 aa, Homo sapiens [sequence omitted]

SEQ ID NO: 859531 - protein, 248 aa, Homo sapiens
SSAINAEWSFKAVLHQPLKVIREILVNQTAHMLACYRKNCASPSAASQLILPDSMKVLPVYMNCLLKNCVLLSRPEISTDERAYQRQLVMTMGVADSQLFFYPQLLPIHTLDVKSTMLPAAVRCSESRLSEEGIFLLANGLHMFLWLGVSSPPELIQGIFNVPSFAHINTDMTLLPEVGNPYSQQLRMIMGIIQQKRPYSMKLTIVKQREQPEMVFRQFLVEDKGLYGGSSYVDFLCCVHKEICQLLN

SEQ ID NO: 859532 - protein, 1015 aa, Homo sapiens [sequence omitted]

SEQ ID NO: 859533 - protein, 853 aa, Homo sapiens
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQPGSQVLPPPPTTLNGPGASPLPLPMYRPDGLSGPPPPNAQYQPPPLPGQTLGAGYPPQQANSGPQMAGAQLSYPGGFPGGPAQMAGPPQPQKKLDPDSIPSPIQVIENDRASRGGQVYATNTRGQIPPLVTTDCMIQDQGNASPRFIRCTTYCFPCTSDMAKQAQIPLAAVIKPFATIPSNESPLYLVNHGESGPVRCNRCKAYMCPFMQFIEGGRRYQCGFCNCVNDVPPFYFQHLDHIGRRLDHYEKPELSLGSYEYVATLDYCRKSKPPNPPAFIFMIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQVSYLWHIDVKVLQTTTHFFST

SEQ ID NO: 859534 - protein, 837 aa, Homo sapiens
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQPGSQVLPPPPTTLNGPGASPLPLPMYRPDGLSGPPPPNAQYQPPPLPGQTLGAGYPPQQANSGPQMAGAQLSYPGGFPGGPAQMAGPPQPQKKLDPDSIPSPIQVIENDRASRGGQVYATNTRGQIPPLVTTDCMIQDQGNASPRFIRCTTYCFPCTSDMAKQAQIPLAAVIKPFATIPSNESPLYLVNHGESGPVRCNRCKAYMCPFMQFIEGGRRYQCGFCNCVNDVPPFYFQHLDHIGRRLDHYEKPELSLGSYEYVATLDYCRKSKPPNPPAFIFMIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQFTCEK

SEQ ID NO: 859535 - protein, 629 aa, Homo sapiens
RRTCQEVGWRGGRALSPVPLRRRAKRRPRVRRSPHPPCPHPRAAAASAGRPSASQVRRSDPRQQVATMVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 859536 - protein, 356 aa, Homo sapiens
PEAGITGAHHNTRLIFVFLVEMGFHHVGQAGLELLTSGDAPTLASQSAGIPGVSHHAPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 859537 - protein, 268 aa, Homo sapiens
MILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 859538 - protein, 629 aa, Homo sapiens; identical to SEQ ID NO: 859535

SEQ ID NO: 859539 - protein, 534 aa, Homo sapiens
RRTCQEVGWRGGRALSPVPLRRRAKRRPRVRRSPHPPCPHPRAAAASAGRPSASQVRRSDPRQQVATMVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMVQVPFSFVNLSPHFLFTCNPTKCNF

SEQ ID NO: 859540 - protein, 359 aa, Homo sapiens
RRTCQEVGWRGGRALSPVPLRRRAKRRPRVRRSPHPPCPHPRAAAASAGRPSASQVRRSDPRQQVATMVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPYQATPRACLVGQKWKATLGSYSLPSMSQ

SEQ ID NO: 859541 - protein, 622 aa, Homo sapiens
RRTCQEVGWRGGRALSPVPLRRRAKRRPRVRRSPHPPCPHPRAAAASAGRPSASQVRRSDPRQQVATMVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSSIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 859542 - protein, 294 aa, Homo sapiens
KGTKAPRWLKSIWNMICSCFDGMDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 859543 - protein, 152 aa, Homo sapiens
MYELGVNQCRGWHSSPVYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 859544 - protein, 269 aa, Homo sapiens
RRTCQEVGWRGGRALSPVPLRRRAKRRPRVRRSPHPPCPHPRAAAASAGRPSASQVRRSDPRQQVATMVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRII

SEQ ID NO: 859545 - protein, 142 aa, Homo sapiens
SSGFGAAPNPARCCFAPFPVIGHPPVVTPLHRKVNCRHVGRGPAGSAEELRMEAAEEALMGPTIPDPSLLPGGPLVSFLVWAEAITWMPTWEGTSNVGPQPLSSSKSLHSPRGHPAPYSHGTGWTQRLWTRGLPLSRDPPSD

SEQ ID NO: 859546 - protein, 103 aa, Homo sapiens
YQGGFIKPVNTPKKINILQMKKKKKKKKKQRGSAPWLAGLGGGSSGELGRPREDPSPGSLLRDDIIRPPPCLQGPPPLHAELLPRGLLPIYTSRYFNPPAIIS

SEQ ID NO: 859547 - protein, 70 aa, Homo sapiens
PPPEAFFKTPYAESHQQPEEKKRRREERPKKGPGQATPNPQPSGKLEPRSSRPAWATWQNPVSTKNTKIS

SEQ ID NO: 859548 - protein, 114 aa, Homo sapiens
SPALFYSPPVARGRAPLPSDPPLGSFSKPRCPPRGFYMGERRPPHCVAVPTVSSFGTRRYGPRDKHTPSGSTPPSPHGGVLKTSFSRARAAPHNCFFFFFFSFFFVFLKSLITS

SEQ ID NO: 859549 - protein, 114 aa, Homo sapiens; identical to SEQ ID NO: 859548

SEQ ID NO: 859550 - protein, 114 aa, Homo sapiens; identical to SEQ ID NO: 859548

SEQ ID NO: 859551 - protein, 114 aa, Homo sapiens; identical to SEQ ID NO: 859548

SEQ ID NO: 859552 - protein, 114 aa, Homo sapiens; identical to SEQ ID NO: 859548

SEQ ID NO: 859553 - protein, 114 aa, Homo sapiens; identical to SEQ ID NO: 859548

SEQ ID NO: 859554 - protein, 456 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 859555 - protein, 252 aa, Homo sapiens [sequence omitted]

SEQ ID NO: 859556 - protein, 433 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 859557 - protein, 208 aa, Homo sapiens [sequence omitted]

SEQ ID NO: 859558 - protein, 433 aa, Homo sapiens; identical to SEQ ID NO: 859556

SEQ ID NO: 859559 - protein, 215 aa, Homo sapiens
AHLFLFPRKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 859560 - protein, 208 aa, Homo sapiens [sequence omitted]

SEQ ID NO: 859561 - protein, 208 aa, Homo sapiens [sequence omitted]

SEQ ID NO: 859562 - protein, 1093 aa, Homo sapiens
PRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQIFDSSGSHGFSGTQLPQNSSNSSEVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRPLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 859563 - protein, 626 aa, Homo sapiens
MEGPRENQDPPPRPLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 859564 - protein, 1054 aa, Homo sapiens
RAIQSSAWRQGGRPSSPQASRARQLPSIEIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRPLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 859565 - protein, 1054 aa, Homo sapiens; identical to SEQ ID NO: 859564

SEQ ID NO: 859566 - protein, 1078 aa, Homo sapiens
RAIQSSAWRQGGRPSSPQASRARQLPSIEIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQIFDSSGSHGFSGTQLPQNSSNSSEVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRPLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 859567 - protein, 112 aa, Homo sapiens
MLCVSACVLVLQRVCVWVVFVFTAPGAYFRLLDSLCSPYASDAFWVGSKPAVSRRRFFLGETRPLSWPGVSLGTGWGPGCSNNGARPPREVFRKPFWAPGAPQFFFFVLYLI

SEQ ID NO: 859568 - protein, 1054 aa, Homo sapiens; identical to SEQ ID NO: 859564

SEQ ID NO: 859569 - protein, 118 aa, Homo sapiens; identical to SEQ ID NO: 806695

SEQ ID NO: 859570 - protein, 209 aa, Homo sapiens
SRQQLESFSNPQIEPLNEGLGFSFSSPLSALKTQSFLLINLIFFSPSLALVAQLEVQWRNLGSLHFHLQGQSDSPAQASPVAGITSCDFRQSPFLELDTNLPANRVPAGLEKRLCAAAASILGKPADRVNVTVRPGLAMALSGSTEPCAQLSISSIGVVGTAEDNRSHSAHFFEFLTKELALGQDRILIRFFPLESWQIGKIGTVMTFL

SEQ ID NO: 859571 - protein, 118 aa, Homo sapiens; identical to SEQ ID NO: 806695

SEQ ID NO: 859572 - protein, 118 aa, Homo sapiens; identical to SEQ ID NO: 806695

SEQ ID NO: 859573 - protein, 118 aa, Homo sapiens; identical to SEQ ID NO: 806695

SEQ ID NO: 859574 - protein, 118 aa, Homo sapiens; identical to SEQ ID NO: 806695

SEQ ID NO: 859575 - protein, 93 aa, Homo sapiens
YLFHCVLPPCVLVNVTVRPGLAMALSGSTEPCAQLSISSIGVVGTAEDNRSHSAHFFEFLTKELALGQDRILIRFFPLESWQIGKIGTVMTFL

SEQ ID NO: 859576 - protein, 128 aa, Homo sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRISLCCPGWSAVARSWLTAVSTFLGSGESPTSAF

SEQ ID NO: 859577 - protein, 146 aa, Homo sapiens
MRSQVAVAPRPSSLVREPWVPPAFLPPELFPFLCPPCRSWSWTRICPPTECPRGWRNDSAPPLPPSWANLRTDTYPLFPLGVLADWQDRDGHDFFMIGHGGIQGICELAASSREISWQSEGLEITSFGLSRMQHSCDHIILFFILI

SEQ ID NO: 859578 - protein, 233 aa, Homo sapiens
MPFLELDTNLPANRVPAGLEKRLCAAAASILGKPADRKRGPGSTGRGEVGGPGVRPCPCSASPTVTPNLFPRDHSPLLSSRQALTFRAPRSRGSPSARLSLVALPSHDPGVTFRDRGPYRDPCPANTARFGFRALGSRPQRSPAGSNFGQNFSCPPQRVNVTVRPGLAMALSGSTEPCAQLSISSIGVVGTAEDNRSHSAHFFEFLTKELALGQDRCVGVVGDPCGTAADWSH

SEQ ID NO: 859579 - protein, 118 aa, Homo sapiens; identical to SEQ ID NO: 806695

SEQ ID NO: 859580 - protein, 118 aa, Homo sapiens; identical to SEQ ID NO: 806695

SEQ ID NO: 859581 - protein, 118 aa, Homo sapiens; identical to SEQ ID NO: 806695

SEQ ID NO: 859582 - protein, 118 aa, Homo sapiens; identical to SEQ ID NO: 806695

SEQ ID NO: 859583 - protein, 106 aa, Homo sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRVPGEVHGRLTE

SEQ ID NO: 859584 - protein, 112 aa, Homo sapiens; identical to SEQ ID NO: 806696

SEQ ID NO: 859585 - protein, 78 aa, Homo sapiens
AAIWRYEEILEIEAMCVETRPNNSKFLKTSFHQPRTSLIITVVEPFYIFTSNEGGFLLLYHLVLSAFWILAVLIEKSE

SEQ ID NO: 859586 - protein, 161 aa, Homo sapiens
MKAVSPVRPSGRKAPSGCGGGELALRCLAEHGHSLGGSAAAAAAAAAARCKAAEAAADEPALCLQCDMNDCYSRLRRLVPTIPPNKKVSKVEILQHVIDYILDLQLALETHPALLRQPPPPAPPHHPAGTCPAAPPRTPLTALNTDPAGAVNKQGDSILCR

SEQ ID NO: 859587 - protein, 117 aa, Homo sapiens
MGDFTHKLDGIFESERIKYGFNWVLCKYVNCVYNVVCLIFKRKGFVSDYTRIKVYRPKGLLMRSNSDIYMNMKYLVPSSQLKWQCLNRNEQNYMLAGYNQSKCLKIDSVLSMLFPQL

SEQ ID NO: 859588 - protein, 161 aa, Homo sapiens; identical to SEQ ID NO: 859586

SEQ ID NO: 859589 - protein, 161 aa, Homo sapiens; identical to SEQ ID NO: 859586

SEQ ID NO: 859590 - protein, 161 aa, Homo sapiens; identical to SEQ ID NO: 859586

SEQ ID NO: 859591 - protein, 161 aa, Homo sapiens; identical to SEQ ID NO: 859586

SEQ ID NO: 859592 - protein, 242 aa, Homo sapiens
MSGCDAREGDCCSRRCGAQDKEHPRYLIPELCKQFYHLGWVTGTGGGISLKHGDEIYIAPSGVQKERIQPEDMFVCDINEKDISGPSPSKKLKKSQCTPLFMNAYTMRGAGAVIHTHSKAAVMATLLFPGREFKITHQEMIKGIKKCTSGGYYRYDDMLVVPIIENTPEEKDLKDRMAHAMNEYPDSCAVLVRRHGVYVWGETWEKAKTMCECYDYLFDIAVSMKKVGLDPSQLPVGENGIV

SEQ ID NO: 859593 - protein, 242 aa, Homo sapiens; identical to SEQ ID NO: 859592

SEQ ID NO: 859594 - protein, 251 aa, Homo sapiens
RPAPGLPSAPPDCICGLAAASQAKRRAQSRAEIGGRAGPWSGPCLAVMLGRETVVPGDAARSDEIYIAPSGVQKERIQPEDMFVCDINEKDISGPSPSKKLKKSQCTPLFMNAYTMRGAGAVIHTHSKAAVMATLLFPGREFKITHQEMIKGIKKCTSGGYYRYDDMLVVPIIENTPEEKDLKDRMAHAMNEYPDSCAVLVRRHGVYVWGETWEKAKTMCECYDYLFDIAVSMKKVGLDPSQLPVGENGIV

SEQ ID NO: 859595 - protein, 205 aa, Homo sapiens
MRRAVAYMAIKIEAQGHQSFAIPSGVQKERIQPEDMFVCDINEKDISGPSPSKKLKKSQCTPLFMNAYTMRGAGAVIHTHSKAAVMATLLFPGREFKITHQEMIKGIKKCTSGGYYRYDDMLVVPIIENTPEEKDLKDRMAHAMNEYPDSCAVLVRRHGVYVWGETWEKAKTMCECYDYLFDIAVSMKKVGLDPSQLPVGENGIV

SEQ ID NO: 859596 - protein, 146 aa, Homo sapiens
MSGCDAREGDCCSRRCGAQDKEHPRYLIPELCKQFYHLGWVTGTGGGISLKHGDEIYIAPSGVQKERIQPEDMFVCDINEKDISGPSPSKKLKKSQCTPLFMNAYTMRGAGAVIHTHSKAAVMATLLFPGREFKITHQEMINMMIC

SEQ ID NO: 859597 - protein, 242 aa, Homo sapiens; identical to SEQ ID NO: 859592

SEQ ID NO: 859598 - protein, 242 aa, Homo sapiens; identical to SEQ ID NO: 859592

SEQ ID NO: 859599 - protein, 259 aa, Homo sapiens
MRRAVAYMAIKIEAQGHQSFAIPSGTFWLWRSLLSQDKEHPRYLIPELCKQFYHLGWVTGTGGGISLKHGDEIYIAPSGVQKERIQPEDMFVCDINEKDISGPSPSKKLKKSQCTPLFMNAYTMRGAGAVIHTHSKAAVMATLLFPGREFKITHQEMIKGIKKCTSGGYYRYDDMLVVPIIENTPEEKDLKDRMAHAMNEYPDSCAVLVRRHGVYVWGETWEKAKTMCECYDYLFDIAVSMKKVGLDPSQLPVGENGIV

SEQ ID NO: 859600 - protein, 285 aa, Homo sapiens
GLLRRPRGGAEHSAEPLCLRPLFPQPRVGAGPRRRTVVSQTKRTGVPGVPGGGQAVGFSAGSLGFAAPGSEMSKPPPKPVKPGQVKVFRALYTFEPRTPDELYFEEGDIIYITDMSDTNWWKGTSKGRTGLIPSNYVAEQAESIDNPLHEAAKRGNLSWLRECLDNRVGVNGLDKAGSTALYWACHGGHKDIVEMLFTQPNIELNQQNKLGDTALHAAAWKGYADIVQLLLAKGARTDLRNIEKKLAFDMATNAACASLLKKKQGTDAVRTLSNAEDYLDDEDSD

SEQ ID NO: 859601 - protein, 239 aa, Homo sapiens
ATAKRAPVPSAPLPAARSPRGPQPLSPRSSWVRGMPGQVKVFRALYTFEPRTPDELYFEEGDIIYITDMSDTNWWKGTSKGRTGLIPSNYVAEQAESIDNPLHEAAKRGNLSWLRECLDNRVGVNGLDKAGSTALYWACHGGHKDIVEMLFTQPNIELNQQNKLGDTALHAAAWKGYADIVQLLLAKGARTDLRNIEKKLAFDMATNAACASLLKKKQGTDAVRTLSNAEDYLDDEDSD

SEQ ID NO: 859602 - protein, 207 aa, Homo sapiens
GLLRRPRGGAEHSAEPLCLRPLFPQPRVGAGPRRRTVVSQTKRTGVPGVPGGGQAVGFSAGSLGFAAPGSEMSKPPPKPVKPGQVKVFRALYTFEPRTPDELYFEEGDIIYITDMSDTNWWKGTSKGRTGLIPSNYVAEQAESIDNPLHEAAKRGNLSWLRECLDNRVGVNGLDKAGSTALYWACHGGHKGITFCLLYVSMLLKMCF

SEQ ID NO: 859603 - protein, 179 aa, Homo sapiens
GLLRRPRGGAEHSAEPLCLRPLFPQPRVGAGPRRRTVVSQTKRTGVPGVPGGGQAVGFSAGSLGFAAPGSEMSKPPPKPVKPGQVKVFRALYTFEPRTPDELYFEEGDIIYITDMSDTNWWKGTSKGRTGLIPSNYVAEQAESIDNPLHEAAKRGNLSWLRECLDNRVGVNGLDKAVYV

SEQ ID NO: 859604 - protein, 527 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAG

SEQ ID NO: 859605 - protein, 141 aa, Homo sapiens
RKVCKKSRWYGRNRDDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAGLYYPKDSARSCCLA

SEQ ID NO: 859606 - protein, 220 aa, Homo sapiens
SLLNSPWLSRLLSLGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAGLYYPKDSARSCCLA

SEQ ID NO: 859607 - protein, 379 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGWLHQELFCGLN

SEQ ID NO: 859608 - protein, 401 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGTMCSVISVINSKCHQPSPPSCSSPPLWASPAGDMTRCPTGTVWIFVPFHISCWNVIPQCKLVQPL

SEQ ID NO: 859609 - protein, 541 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAGLYYPKDSARSCCLA

SEQ ID NO: 859610 - protein, 541 aa, Homo sapiens; identical to SEQ ID NO: 859609

SEQ ID NO: 859611 - protein, 428 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFEQLCGLIQCA

SEQ ID NO: 859612 - protein, 315 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWSWSMSV

SEQ ID NO: 859613 - protein, 1516 aa, Homo sapiens
MDSPPKLTGETLIVHHIPLVHCQVPDRQCCGGAGGGGGSTRPNPFCPPELGITQPDQDLGQADSLLFSSLHSAPGGTARSIDSTKSRSRDGRGPGAPKRHNPFLLQEGVGEPGLGDLYDDSIGDSATQQSFHLHGTGQPNFHLSSFQLPPSGPRVGRPWGTTRSRAGVVEGQEQEPVMTLDTQQCGTSHCCRPELEAETMELDECGGPGGSGSGGGASDTSGFSFDQEWKLSSDESPRNPGCSGSGDQHCRCSSTSSQSEAADQSMGYVSDSSCNSSDGVLVTFSTLYNKMHGTPRANLNSAPQSCSDSSFCSHSDPGAFYLDLQPSPFESKMSYESHHPESGGREGGYGCPHASSPELDANCNSYRPHCEPCPAVADLTACFQSQARLVVATQNYYKLVTCDLSSQSSPSPAGSSITSCSEEHTKISPPPGPGPDPGPSQPSEYYLFQKPEVQPEEQEAVSSSTQAAAAVGPTVLEGQVYTNTSPPNLSTGRQRSRSYDRSLQRSPPVRLGSLERMLSCPVRLSEGPAAMAGPGSPPRRVTSFAELAKGRKKTGGSGSPPLRVSVGDSSQEFSPIQEAQQDRGAPLDEGTCCSHSLPPMPLGPGMDLLGPDPSPPWSTQVCQGPHSSEMPPAGLRATGQGPLAQLMDPGPALPGSPANSHTQRDARARADGGGTESRPVLRYSKEQRPTTLPIQPFVFQHHFPKQLAKARALHSLSQLYSLSGCSRTQQPAPLAAPAAQVSVPAPSGEPQASTPRATGRGARKAGSEPETSRPSPLGSYSPIRSVGPFGPSTDSSASTSCSPPPEQPTATESLPPWSHSCPSAVRPATSQQPQKEDQKILTLTEYRLHGTGSLPPLGSWRSGLSRAESLARGGGEGSMATRPSNANHLSPQALKWREYRRKNPLGPPGLSGSLDRRSQEARLARRNPIFEFPGSLSAASHLNCRLNGQAVKPLPLTCPDFQDPFSLTEKPPAEFCLSPDGSSEAISIDLLQKKGLVKAVNIAVDLIVAHFGTSRDPGVKAKLGNSSVSPNVGHLVLKYLCPAVRAVLEDGLKAFVLDVIIGQRKNMPWSVVEASTQLGPSTKVLHGLYNKVSQFPELTSHTMRFNAFILGLLNIRSLEFWFNHLYNHEDIIQTHYQPWGFLSAAHTVCPGLFEELLLLLQPLALLPFSLDLLFQHRLLQSGQQQRQHKELLRVSQDLLLSAHSTLQLARARGQEGPGDVDRAAQGERVKGVGASEGGEEEEEEEETEEVAEAAGGSGRARWARGGQAGWWYQLMQSSQVYIDGSIEGSRFPRGSSNSSSEKKKGAGGGGPPQAPPPREGVVEGAEACPASEEALGRERGWPFWMGSPPDSVLAELRRSREREGPAASPAENEEGASEPSPGGIKWGHLFGSRKAQREARPTNRLPSDWLSLDKSMFQLVAQTVGSRREPEPKESLQEPHSPALPSSPPCEVQALCHHLATGPGQLSFHKGDILRVLGRAGGDWLRCSRGPDSGLVPLAYVTLTPTPSPTPGSSQN

SEQ ID NO: 859614 - protein, 518 aa, Homo sapiens
MHKARQVQGKARQGTSRDPGVKAKLGNSSVSPNVGHLVLKYLCPAVRAVLEDGLKAFVLDVIIGQRKNMPWSVVEASTQLGPSTKVLHGLYNKVSQFPELTSHTMRFNAFILGLLNIRSLEFWFNHLYNHEDIIQTHYQPWGFLSAAHTVCPGLFEELLLLLQPLALLPFSLDLLFQHRLLQSGQQQRQHKELLRVSQDLLLSAHSTLQLARARGQEGPGDVDRAAQGERVKGVGASEGGEEEEEEEETEEVAEAAGGSGRARWARGGQAGWWYQLMQSSQVYIDGSIEGSRFPRGSSNSSSEKKKGAGGGGPPQAPPPREGVVEGAEACPASEEALGRERGWPFWMGSPPDSVLAELRRSREREGPAASPAENEEGASEPSPGGIKWGHLFGSRKAQREARPTNRLPSDWLSLDKSMFQLVAQTVGSRREPEPKESLQEPHSPALPSSPPCEVQALCHHLATGPGQLSFHKGDILRVLGRAGGDWLRCSRGPDSGLVPLAYVTLTPTPSPTPGSSQN

SEQ ID NO: 859615 - protein, 157 aa, Homo sapiens
PGWYAPEWDIVDHAVWASEPSPGGIKWGHLFGSRKAQREARPTNRLPSDWLSLDKSMFQLVAQTVGSRREPEPKESLQEPHSPALPSSPPCEVQALCHHLATGPGQLSFHKGDILRVLGRAGGDWLRCSRGPDSGLVPLAYVTLTPTPSPTPGSSQN

SEQ ID NO: 859616 - protein, 178 aa, Homo sapiens
MDSPPKLTGETLIVHHIPLVHCQVPDRQCCGGAGGGGGSTRPNPFCPPELGITQPDQDLGQADSLLFSSLHSAPGGTARSIDSTKSRSRDGRGPGAPKRHNPFLLQEGVGEPGLGDLYDDSIGDSATQQSFHLHGTGQPNFHLSSLVCKRREDKGPKECHVALLLCEDSSCGGSCRLY

SEQ ID NO: 859617 - protein, 1516 aa, Homo sapiens; identical to SEQ ID NO: 859613

SEQ ID NO: 859618 - protein, 1516 aa, Homo sapiens; identical to SEQ ID NO: 859613

SEQ ID NO: 859619 - protein, 427 aa, Homo sapiens
MTSAQPAPLSAAALPRLSFKVPLGPGSGSLCGSVPLSFPLDIIQTHYQPWGFLSAAHTVCPGLFEELLLLLQPLALLPFSLDLLFQHRLLQSGQQQRQHKELLRVSQDLLLSAHSTLQLARARGQEGPGDVDRAAQGERVKGVGASEGGEEEEEEEETEEVAEAAGGSGRARWARGGQAGWWYQLMQSSQVYIDGSIEGSRFPRGSSNSSSEKKKGAGGGGPPQAPPPREGVVEGAEACPASEEALGRERGWPFWMGSPPDSVLAELRRSREREGPAASPAENEEGASEPSPGGIKWGHLFGSRKAQREARPTNRLPSDWLSLDKSMFQLVAQTVGSRREPEPKESLQEPHSPALPSSPPCEVQALCHHLATGPGQLSFHKGDILRVLGRAGGDWLRCSRGPDSGLVPLAYVTLTPTPSPTPGSSQN

SEQ ID NO: 859620 - protein, 159 aa, Homo sapiens
MDHSHHMGMSYMDSNSTMQPSHHHPTTSASHSHGGGDSSMMMMPMTFYFGFKNVELLFSGLVINTAGEMAGAFVAVFLLAMFYEGLKIARESLLRKSQVSIRYNSMPVPGPNGTILMETHKTVGQQMLSFPHLLQTSRSAGITGMSHHTCPSPPRITQT

SEQ ID NO: 859621 - protein, 146 aa, Homo sapiens
MTFYFGFKNVELLFSGLVINTAGEMAGAFVAVFLLAMFYEGLKIARESLLRKSQVSIRYNSMPVPGPNGTILMETHKTVGQQMLSFPHLLQTVLHIIQVVISYFLMLIFMTYNGYLCIAVAAGAGTGYFLFSWKKAVVVDITEHCH

SEQ ID NO: 859622 - protein, 190 aa, Homo sapiens
MDHSHHMGMSYMDSNSTMQPSHHHPTTSASHSHGGGDSSMMMMPMTFYFGFKNVELLFSGLVINTAGEMAGAFVAVFLLAMFYEGLKIARESLLRKSQVSIRYNSMPVPGPNGTILMETHKTVGQQMLSFPHLLQTVLHIIQVVISYFLMLIFMTYNGYLCIAVAAGAGTGYFLFSWKKAVVVDITEHCH

SEQ ID NO: 859623 - protein, 190 aa, Homo sapiens; identical to SEQ ID NO: 859622

SEQ ID NO: 859624 - protein, 79 aa, Homo sapiens
AGDLEDPPIITHVGITACHLHDLQRVPLHCSSSRGRYRILPLQLEEGSGSGYHRALPLTSNSMAWPYRLQWEVVEDLKT

SEQ ID NO: 859625 - protein, 386 aa, Homo sapiens
EARRGAARGRSRSYGTKAPPPPCLPPRWSNASRRRGSRRRWRRWSSSRGPATRGASTSLRTALPPAAEPSLLAMSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 859626 - protein, 386 aa, Homo sapiens; identical to SEQ ID NO: 859625

SEQ ID NO: 859627 - protein, 386 aa, Homo sapiens; identical to SEQ ID NO: 859625

SEQ ID NO: 859628 - protein, 386 aa, Homo sapiens; identical to SEQ ID NO: 859625

SEQ ID NO: 859629 - protein, 288 aa, Homo sapiens
MITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 859630 - protein, 178 aa, Homo sapiens
EARRGAARGRSRSYGTKAPPPPCLPPRWSNASRRRGSRRRWRRWSSSRGPATRGASTSLRTALPPAAEPSLLAMSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASI

SEQ ID NO: 859631 - protein, 200 aa, Homo sapiens
MPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 859632 - protein, 127 aa, Homo sapiens
MQSTPFCGFCSLGKMITAKPGKTPIQVLHEYGMKTKNIPVYECERSDVQIHVPTFTFRVTVGDITCTGEGTSKKLAKHRAAEAAINILKANASIWNWLFIMAGDFLNIPFPRREDLLIRENILQFAG

SEQ ID NO: 859633 - protein, 180 aa, Homo sapiens
MQSTPFCGFCSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETDKCSRTFFRMYLAFLEEFSW

SEQ ID NO: 859634 - protein, 261 aa, Homo sapiens
EARRGAARGRSRSYGTKAPPPPCLPPRWSNASRRRGSRRRWRRWSSSRGPATRGASTSLRTALPPAAEPSLLAMSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGTYFLQLKAFEIFSDDE

SEQ ID NO: 859635 - protein, 177 aa, Homo sapiens
MQSTPFCGFCSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGTYFLQLKAFEIFSDDE

SEQ ID NO: 859636 - protein, 386 aa, Homo sapiens; identical to SEQ ID NO: 859625

SEQ ID NO: 859637 - protein, 302 aa, Homo sapiens
MQSTPFCGFCSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 859638 - protein, 329 aa, Homo sapiens
RPAEEQRGGVAGATAPRLRPHPACPLAGATQAGGGGVGGGGGAGAPPGDQRPGERARRSAPLFLQPLSRPFSPCPRAGTAPRPRRWSARTVGPSGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 859639 - protein, 228 aa, Homo sapiens
MQVFGELNFFVFSSSKISWLSFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 859640 - protein, 386 aa, Homo sapiens; identical to SEQ ID NO: 859625

SEQ ID NO: 859641 - protein, 361 aa, Homo sapiens
EARRGAARGRSRSYGTKAPPPPCLPPRWSNASRRRGSRRRWRRWSSSRGPATRGASTSLRTALPPAAEPSLLAMSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIGMIFFSLAFPRHVYLKMCLRNKNVFEE

SEQ ID NO: 859642 - protein, 221 aa, Homo sapiens
EARRGAARGRSRSYGTKAPPPPCLPPRWSNASRRRGSRRRWRRWSSSRGPATRGASTSLRTALPPAAEPSLLAMSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQVSCTVLCLLMKYIISL

SEQ ID NO: 859643 - protein, 114 aa, Homo sapiens
MLSGARCRLASALRGTRAPPSAVARRCLHASGSRPLADRGKKTEEPPRDFDPALLEFLVCPLSKKPLRYEASTNELINEELGIAYPIIDGIPNMIPQAARMTRQSKKQEEVEQR

SEQ ID NO: 859644 - protein, 108 aa, Homo sapiens
MLSGARCRLASALRGTRAPPSAVARRCLHASGSRPLADRGKKTEEPPRDFDPALLEFLVCPLSKKPLRYEASTNELINEELGIAYPIIDGIPNMIPQAARMTRQSSDL

SEQ ID NO: 859645 - protein, 885 aa, Homo sapiens
AAAVGAKPGPRSQSRSRAGRGVMAGPRGALLAWCRRQCEGYRGVEIRDLSSSFRDGLAFCAILHRHRPDLLDFDSLSKDNVFENNRLAFEVAEKELGIPALLDPNDMVSMSVPDCLSIMTYVSQYYNHFCSPGQAGVSPPRKGLAPCSPPSVAPTPVEPEDVAQGEELSSGSLSEQGTGQTPSSTCAACQQHVHLVQRYLADGRLYHRHCFRCRRCSSTLLPGAYENGPEEGTFVCAEHCARLGPGTRSGTRPGPFSQPKQQHQQQLAEDAKDVPGGGPSSSAPAGAEADGPKASPEARPQIPTKPRVPGKLQELASPPAGRPTPAPRKASESTTPAPPTPRPRSSLQQENLVEQAGSSSLVNGRLHELPVPKPRGTPKPSEGTPAPRKDPPWITLVQAEPKKKPAPLPPSSSPGPPSQDSRQVENGGTEEVAQPSPTASLESKPYNPFEEEEEDKEEEAPAAPSLATSPALGHPESTPKSLHPWYGITPTSSPKTKKRPAPRAPSASPLALHASRLSHSEPPSATPSPALSVESLSSESASQTAGAELLEPPAVPKSSSEPAVHAPGTPGNPVSLSTNSSLASSGELVEPRVEQMPQASPGLAPRTRGSSGPQPAKPCSGATPTPLLLVGDRSPVPSPGSSSPQLQVKSSCKENPFNRKPSPAASPATKKATKGSKPVRPPAPGHGFPLIKRKVQADQYIPEEDIHGEMDTIERRLDALEHRGVLLEEKLRGGLNEGREDDMLVDWFKLIHEKHLLVRRESELIYVFKQQNLEQRQADVEYELRCLLNKPEKDWTEEDRAREKVLMQELVTLIEQRNAIINCLDEDRQREEEEDKMLEAMIKKKEFQREAEPEGKKKGKFKTMKMLKLLGNKRDAKSKSPRDKS

SEQ ID NO: 859646 - protein, 885 aa, Homo sapiens; identical to SEQ ID NO: 859645

SEQ ID NO: 859647 - protein, 885 aa, Homo sapiens; identical to SEQ ID NO: 859645

SEQ ID NO: 859648 - protein, 885 aa, Homo sapiens; identical to SEQ ID NO: 859645

SEQ ID NO: 859649 - protein, 885 aa, Homo sapiens; identical to SEQ ID NO: 859645

SEQ ID NO: 859650 - protein, 66 aa, Homo sapiens
EQTTAYIQTLNLFPTFPPFLFCCCLLQLQQTQHEKPVGDCPLLEQLLGCALFEGGALLPSDQSGGR

SEQ ID NO: 859651 - protein, 837 aa, Homo sapiens
VSLPSYGGGDGGHDNFQLSGALGDFDSLSKDNVFENNRLAFEVAEKELGIPALLDPNDMVSMSVPDCLSIMTYVSQYYNHFCSPGQAGVSPPRKGLAPCSPPSVAPTPVEPEDVAQGEELSSGSLSEQGTGQTPSSTCAACQQHVHLVQRYLADGRLYHRHCFRCRRCSSTLLPGAYENGPEEGTFVCAEHCARLGPGTRSGTRPGPFSQPKQQHQQQLAEDAKDVPGGGPSSSAPAGAEADGPKASPEARPQIPTKPRVPGKLQELASPPAGRPTPAPRKASESTTPAPPTPRPRSSLQQENLVEQAGSSSLVNGRLHELPVPKPRGTPKPSEGTPAPRKDPPWITLVQAEPKKKPAPLPPSSSPGPPSQDSRQVENGGTEEVAQPSPTASLESKPYNPFEEEEEDKEEEAPAAPSLATSPALGHPESTPKSLHPWYGITPTSSPKTKKRPAPRAPSASPLALHASRLSHSEPPSATPSPALSVESLSSESASQTAGAELLEPPAVPKSSSEPAVHAPGTPGNPVSLSTNSSLASSGELVEPRVEQMPQASPGLAPRTRGSSGPQPAKPCSGATPTPLLLVGDRSPVPSPGSSSPQLQVKSSCKENPFNRKPSPAASPATKKATKGSKPVRPPAPGHGFPLIKRKVQADQYIPEEDIHGEMDTIERRLDALEHRGVLLEEKLRGGLNEGREDDMLVDWFKLIHEKHLLVRRESELIYVFKQQNLEQRQADVEYELRCLLNKPEKDWTEEDRAREKVLMQELVTLIEQRNAIINCLDEDRQREEEEDKMLEAMIKKKEFQREAEPEGKKKGKFKTMKMLKLLGNKRDAKSKSPRDKS

SEQ ID NO: 859652 - protein, 885 aa, Homo sapiens; identical to SEQ ID NO: 859645

SEQ ID NO: 859653 - protein, 894 aa, Homo sapiens
AAAVGAKPGPRSQSRSRAGRGVMAGPRGALLAWCRRQCEGYRGVEIRDLSSSFRDGLAFCAILHRHRPDLLDFDSLSKDNVFENNRLAFEVAEKELGIPALLDPNDMVSMSVPDCLSIMTYVSQYYNHFCSPGQAGVSPPRKGLAPCSPPSVAPTPVEPEDVAQGEELSSGSLSEQGTGQTPSSTCAACQQHVHLVQRYLADGRLYHRHCFRCRRCSSTLLPGAYENGPEEGTFVCAEHCARLGPGTRSGTRPGPFSQPKQQHQQQLAEDAKDVPGGGPSSSAPAGAEADGPKASPEARPQIPTKPRVPGKLQELASPPAGRPTPAPRKASESTTPAPPTPRPRSSLQQENLVEQAGSSSLVNGRLHELPVPKPRGTPKPSEGTPAPRKDPPWITLVQAEPKKKPAPLPPSSSPGPPSQDSRQVENGGTEEVAQPSPTASLESKPYNPFEEEEEDKEEEAPAAPSLATSPALGHPESTPKSLHPWYGITPTSSPKTKKRPAPRAPSASPLALHASRLSHSEPPSATPSPALSVESLSSESASQTAGAELLEPPAVPKSSSEPAVHAPGTPGNPVSLSTNSSLASSGELVEPRVEQMPQASPGLAPRTRGSSGPQPAKPCSGATPTPLLLVGDRSPVPSPGSSSPQLQVKSSCKENPFNRKPSPAASPATKKATKGSKPVRPPAPGHGFPLIKRKVQADQYIPEEDIHGEMDTIERRLDALEHRGVLLEEKLRGGLNEGREDDMLVDWFKLIHEKHLLVRRESELIYVFKQQNLEQRQADVEYELRCLLNKPEKDWTEEDRAREKVLMQELVTLIEQRNAIINCLDEDRQREEEEDKMLEAMIKKKGEALAGDEAEFQREAEPEGKKKGKFKTMKMLKLLGNKRDAKSKSPRDKS

SEQ ID NO: 859654 - protein, 885 aa, Homo sapiens; identical to SEQ ID NO: 859645

SEQ ID NO: 859655 - protein, 71 aa, Homo sapiens
MGLRRAPLCVQNTVPGWARGHGRGPGLGPSHSQSSSTSSNSQKMPRMFQEAAPAPVLLQGLRPMDPRPALR

SEQ ID NO: 859656 - protein, 228 aa, Homo sapiens
APGGGGRGWGPSGVRGNKMATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 859657 - protein, 210 aa, Homo sapiens
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 859658 - protein, 228 aa, Homo sapiens; identical to SEQ ID NO: 859656

SEQ ID NO: 859659 - protein, 108 aa, Homo sapiens
MQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 859660 - protein, 183 aa, Homo sapiens
RVPYLRSYTLLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 859661 - protein, 169 aa, Homo sapiens
GLWIRSCFIPLVSRHILKNMEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 859662 - protein, 228 aa, Homo sapiens; identical to SEQ ID NO: 859656

SEQ ID NO: 859663 - protein, 95 aa, Homo sapiens
ESKKAARADLGLGFLQFQQKVCQSDNKPMVNLDKLKERAQRFGLNVSSISRKSEDDEKLKKRKERFGIVTSSAGTGTTEDTEAKKRKRAERFGIA

SEQ ID NO: 859664 - protein, 169 aa, Homo sapiens
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKVM

SEQ ID NO: 859665 - protein, 180 aa, Homo sapiens
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKAKKRKRAERFGIA

SEQ ID NO: 859666 - protein, 136 aa, Homo sapiens
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKV

SEQ ID NO: 859667 - protein, 210 aa, Homo sapiens; identical to SEQ ID NO: 859657

SEQ ID NO: 859668 - protein, 228 aa, Homo sapiens; identical to SEQ ID NO: 859656
